United States Patent 7,504,111 (GONOCOCCAL PROTEINS AND NUCLEIC ACIDS) - sequence listing, part 2

SEQ ID NO: 4999 - DNA, 807 bp, Neisseria gonorrhoeae
atgataccgctcaaaatcgccatcgccggcgcaaacggccgcatgggacgcgtcctcgtcgaagccgtcaacaaccatcccgacaccgtcctttccggcgcgctcgaacactcaggctcagaagccctcgggctggacgcgggctacgccgtcggactcaaaaccggcatcgccatttcagacgacgttgacgccgttctcgcccaaagcgacgtactcatcgacttcacccgccccgagccgaccctcaagcacctgcaaaaatgcgttgaaaaacaagtcaacatcatcatcggcacaacaggcttcgacgatgcgggcaaagccgccatccgcgccgccgccgaaaaaacaggcatcgttttcgccgccaacttcagcgtcggcgtcaacctcaccttccacatcctcgacaccgtcgcccgcgtcctcaacgaaggctacgacatcgaaatcatcgaaggccaccaccgccacaaagtcgatgcccccagcggcacagcattacgaatgggcgaagtcatcgccggcgcgctcggccgcgacctcaaacaatgcgccgtttacggccgcgaaggccacactggtccgcgcgatccttccaccatcggctttgccaccgtccgcgcaggcgacatagtcggcgaccacaccgccctcttcgccaccgacggcgaacgcgtggaaatcacccacaaagccggcagccgcatgacctttgccgccggtgccgtccgcgccgcagtttgggtaaacggcaaaacgggtttgtacgatatgcaggacgtactcgggctgaacaaccgt

SEQ ID NO: 5000 - protein, 269 aa, Neisseria gonorrhoeae
MIPLKIAIAGANGRMGRVLVEAVNNHPDTVLSGALEHSGSEALGLDAGYAVGLKTGIAISDDVDAVLAQSDVLIDFTRPEPTLKHLQKCVEKQVNIIIGTTGFDDAGKAAIRAAAEKTGIVFAANFSVGVNLTFHILDTVARVLNEGYDIEIIEGHHRHKVDAPSGTALRMGEVIAGALGRDLKQCAVYGREGHTGPRDPSTIGFATVRAGDIVGDHTALFATDGERVEITHKAGSRMTFAAGAVRAAVWVNGKTGLYDMQDVLGLNNR

SEQ ID NO: 5001 - DNA, 1473 bp, Neisseria gonorrhoeae
ttgataatggttattttttatttttatttttgtgggaagacatttatgcctgcacgaaacagatggatgctgctgcctttattggcaagcgcggcatacgccgaagaaacaccgtgcgaaccggatttgagaagccgtcccgagttcaggcttcatgaagcggaggtcaaaccgatcgacagggagaaggtaccggggcaggtgcgggaaaaaggaaaagttttgcaggttgacggcgaaaccctgctgaaaaatcccgaattgttgtcgcgtgccatgtattccgcagtggtctcaaacaatattgccggtatccgcgtgattttgccgatttacctacaacaggcgcggcaggataagatgttggcactttatgcacaagggattttggcgcaggcagagggcagggtgaaggaggcggtttcccattaccgggaattgattgccgcccaacccgacgcgcccgccgtccgtatgcgtttggcggcggcattgtttgaagacaggcagaacgaggcggcggcagaccagttcgaccgcctgaaaacagaagatctgccgccgcagcttatggagcaggtcgagctgtaccgcaaggcattgcgcgaacgcgatgcgtggaaggtaaacggcggtttcagcgttacccgcgaacacaatatcaaccaagccccgaaacagcagcagtacggcaattggactttcccgaaacaggtggacggcacggcagtcaattaccggttcggcgcggagaaaaaatggtcgctgaaaaacggctggtacacgacggcgggcggcgacgtgtccggcagggtttatccggggaataagaaattcaacgatatgacggcaggtgtttccggcggcatcggttttgccgaccggcgtaaagatgtcgggctggcagtgttccacgaacgccgcacctacggcaacgacgcttattcttacgccaacggcgcacgcctttatttcaaccgttggcaaaccccgagatggcaaacgctgtcttcggcggagtgggggcgtttgaagaatacgcgccgggcgcgttccgacaatacccatttgcaaatttccaattcgctggtgttttaccggaatgcgcgccaatattggacgggcggtttggatttttaccgcgagcgcaaccccgccgaccgtggcgacaatttcaaccgttacggcctgcgctttgcctgggggcaggaatggggcggcagcggcctgtcttcgctgttccgcctcggcgtggcgaaacggcattatgaaaaacccggcttcttcagcagttttaaaggggaaaggcgcagggataaagaatcggacacatccttgagcctttggcaccgggcattgcatttcaaaggcatcacgccgcgcctgacgctgtcgcaccgcgaaacgtggagcaacgatgtgtttaacgaatacgagaaaaacagggcgtttgtcgagtttaacaaaacgttc

SEQ ID NO: 5002 - protein, 491 aa, Neisseria gonorrhoeae
LIMVIFYFYFCGKTFMPARNRWMLLPLLASAAYAEETPCEPDLRSRPEFRLHEAEVKPIDREKVPGQVREKGKVLQVDGETLLKNPELLSRAMYSAVVSNNIAGIRVILPIYLQQARQDKMLALYAQGILAQAEGRVKEAVSHYRELIAAQPDAPAVRMRLAAALFEDRQNEAAADQFDRLKTEDLPPQLMEQVELYRKALRERDAWKVNGGFSVTREHNINQAPKQQQYGNWTFPKQVDGTAVNYRFGAEKKWSLKNGWYTTAGGDVSGRVYPGNKKFNDMTAGVSGGIGFADRRKDVGLAVFHERRTYGNDAYSYANGARLYFNRWQTPRWQTLSSAEWGRLKNTRRARSDNTHLQISNSLVFYRNARQYWTGGLDFYRERNPADRGDNFNRYGLRFAWGQEWGGSGLSSLFRLGVAKRHYEKPGFFSSFKGERRRDKESDTSLSLWHRALHFKGITPRLTLSHRETWSNDVFNEYEKNRAFVEFNKTF

SEQ ID NO: 5003 - DNA, 2556 bp, Neisseria gonorrhoeae
atgcctgaaaacctgtcttcagcactggaaaccttcaaacagcagcgcaatgccgccgaagcgcattatttgaaagccaaccgcgtgtcggtatttttcagagaatacacggcggcagtcgaaaccttgctggcggcattgtgggcagaacattttcaaaacagcgcgttatgcctgatggcggtaggcggcttcgggcgcggcgaaccgtatccctgttcggatgtggatttggcggttgtctcccctgccccgctttcagacggcattcaggaacagattgcccgatttatccaaactctgtgggattgcaaactaatgccgtctgtaaaaagcggcagcgttgacgaactgtgcgaaagcgtgcgcgacgatattacgggggacacagcgtttttagaggctaggtttttgtttggcaaccgccaaacagcagacgaattggcggaaaaaatgaacgtgcaacgcaatgtagcggcatttatcgaagcaaaattggtggagatggaacaccgccacgccaaatcgcaaggttcgggggcggtgttggagccgaatatcaaaagctgtccgggcggtctgcgcgacatccacaccctgctttggatagcgaaggcgcaaggcttggcggccaacctgcccgacctgctcaaacagcggattttgacacgtgccgaagccggtatgctttcgcacggctaccgccgcctcgcccacatccgcatccggctgcatttaaacgccaagcgcgccgaagaccgcctgcttttcgatttgcagccgcaagttgccgaaagtatgggttatcaagatgaaaaccgccgccgtcaaagcgaagaactgatgcgcgtgttttaccgtgcggtcaaaaccgtcaaacaactgggcggcatcctcacgcccatgctgcgaagccgcgtttcctccacgccggtgcgcgttaccctgcggattgacgacgactacatccaagtcaacaaccaaatcgccgcgcggcacaccgatatttttttcagacggcccgaacacattttcaaaatcgtcgaaatcatgcagcagcgcaacgacattactgcgctcgaaccgcaaaccctgcgcgcatggtggggggcgacgcgcaaaatcaaccgcagcttctaccaaaattctgaaaaccgtcgccgcttcgccggttttttccgcagcggcaacggactgacccaaaccctgcgctttctcaacctctacggcgtgttgggccgctatctgcccgcgtgggaaaaaatcgtcggcctgcttcaacacgacttgttccacatctatcccgtggacgaccacatccttgccgtcgtccgcaacgtccgccgccttgccctagatatgcacagccatgagctgccctacgcctccgcgctgatgcagtcctttgaaaaacaagacatcctctaccttgccgccttcttccacgacatcgccaaaggacgcggcggcgaccatgccgtacaaggcatcgcagacgcgcgccaatttgccgccgaccacttcctgaccgaagaagaaagcgacctgctcgcctggctggttgaaaaccacctccttatgtctgccgtcgcccaaaaagaagacatccaagaccccggcgtactcgatgccttctgcaaacgcgtccaaacccacgaacgcctcagcgcgctctacctcctgaccatttccgacatacgcggcaccaatcccaagctgtggaacgcctggcgcgccagcctgctggaaagcctgttccacgccgccggacgctgcctcgcaggcaacgacggcaacccgcacgccctcttcggccgccgccggcaggaagccgccgacttacttacccgcgccgccgtccccgaaaaacagcagaaaaaactatggaacgcgctcggttccgcctatttcgcccgccatcagtcccgcgaaatcctgtggcacgccgccaacctcgtacacgactttgaaccccccatcgtccgcagccgcatcctaccccaaagcgacagctttcaagtgatggtctttatgcccaacggcccgcgcctgttcgcccgcctctgccgcatcttcagccgccacggcttcgatatcctcgccgcccgcgcctttatcaccgaacacgactacatcctcgacaccttcatcgtgcaaatcccctcgcagcacgcccccgaagactaccccgacatccaaagcgcgctcgaagccgaactcaacagctttatccacggacacaccgttgccgaaacccaaagctgcaaccgccgcatcagccgccgcagccgctatatgcctattgcgccaagcatcaccatcacccccgaagaagactatccggaccggtattccgtcgaaatcaccgccgtcaaccgccccttcctgctcgccgacatggcggaagtcttcttcgcccacaacgtcagcctgcgctacgccaaaatctccacgttggacgaacgcgtcgaagacagctttaccgtcttcagccccgacttgaaaaacccaaaaatccagtcctcattgaaacaggctttgctggaacagttggca

SEQ ID NO: 5004 - protein, 852 aa, Neisseria gonorrhoeae
MPENLSSALETFKQQRNAAEAHYLKANRVSVFFREYTAAVETLLAALWAEHFQNSALCLMAVGGFGRGEPYPCSDVDLAVVSPAPLSDGIQEQIARFIQTLWDCKLMPSVKSGSVDELCESVRDDITGDTAFLEARFLFGNRQTADELAEKMNVQRNVAAFIEAKLVEMEHRHAKSQGSGAVLEPNIKSCPGGLRDIHTLLWIAKAQGLAANLPDLLKQRILTRAEAGMLSHGYRRLAHIRIRLHLNAKRAEDRLLFDLQPQVAESMGYQDENRRRQSEELMRVFYRAVKTVKQLGGILTPMLRSRVSSTPVRVTLRIDDDYIQVNNQIAARHTDIFFRRPEHIFKIVEIMQQRNDITALEPQTLRAWWGATRKINRSFYQNSENRRRFAGFFRSGNGLTQTLRFLNLYGVLGRYLPAWEKIVGLLQHDLFHIYPVDDHILAVVRNVRRLALDMHSHELPYASALMQSFEKQDILYLAAFFHDIAKGRGGDHAVQGIADARQFAADHFLTEEESDLLAWLVENHLLMSAVAQKEDIQDPGVLDAFCKRVQTHERLSALYLLTISDIRGTNPKLWNAWRASLLESLFHAAGRCLAGNDGNPHALFGRRRQEAADLLTRAAVPEKQQKKLWNALGSAYFARHQSREILWHAANLVHDFEPPIVRSRILPQSDSFQVMVFMPNGPRLFARLCRIFSRHGFDILAARAFITEHDYILDTFIVQIPSQHAPEDYPDIQSALEAELNSFIHGHTVAETQSCNRRISRRSRYMPIAPSITITPEEDYPDRYSVEITAVNRPFLLADMAEVFFAHNVSLRYAKISTLDERVEDSFTVFSPDLKNPKIQSSLKQALLEQLA

SEQ ID NO: 5005 - DNA, 1494 bp, Neisseria gonorrhoeae
gtgcatcttgcacaaaccgaaagaccgagcattatgcgtatcgtagaaaaagcctatactttcgacgatgttttgttggttcccgcacattcgaccgtgctgccgcgagacgttaaacttcaaaccaagcttacccgcgaaatcacactcaacctccccctgctttccgccgcgatggataccgttaccgaggcgcgcctcgccatttcgatggcacaggaaggcggcatcggcatcatccataaaaacatgccgcccgaaatgcaggcgcgcgccgtttccaaagtaaaacgccacgaaagcggcgtggtcaaagaccccgtaaccgttgcgccgacaacgctcatccgcgaagtcttggaaatgcgcgcgcagcgcaaacgcaaaatgtccggcctgcccgtcgttgaaaacggcaaagtcgtcggcatcgtaaccaaccgcgacctgcgttttgaaaaccgcgtcgatttgcccgtttccgccattatgaccccgcgcgaacgtctggttaccgtccccgaaggcacaagcatagacgaagcgcgcgaactgatgcacacgtacaaagtcgaacgcgttttggtcctgaacgaaaaagacgagcttaaaggcttgattaccattaaagatattttaaaaaccaccgagtttcccaatgccaacaaagactccgaaggccgtctgcgcgtcggtgcggcagtcggcaccggcggcgacaccgacgagcgcgtcaaagccttggtcgaagccggcgcggacgtgattgtcgtcgatactgcccacggtcatagccaaggcgtgatcgaccgcgtgcgttgggtcaaagaaacctatccgcacatccaagtcatcggcggcaacatcgccactgccaaagccgcattggatttggtcaccgtcggcgcggatgccgtcaaagtcggtatcggtccgggatcgatttgcaccacccgtatcgtggcaggcgtgggcgtgccgcaactgaccgccattcacaacgttgccgaagccctcaaaggcacgggcgttccgctgattgccgacggcggcatccgcttctccggcgacatcgccaaagccctcgccgcaggcgcgtacagcgtcatgctcggcggtatgtttgccggcacggaagaagccccgggcgaaatcgaactctaccaaggccgctcgtacaaatcctatcgcggtatgggttccttgggcgcgatgagccaaggttctgccgaccgctacttccaagacaaaaccgacagcaccgacaaatacgtccccgaaggcatcgaaggccgcgttccctacaaaggcccgattgtgaacatcatccaccaactgaccggcggactgcgttccagtatgggttatttgggttgcgccaatattgccgaaatgcacgaaaaagccgaatttgtggaaatcacttccgcaggtatgagcgaatcgcacgttcacgacgttcaaattaccaaagaagcgccgaattaccaccgc

SEQ ID NO: 5006 - protein, 498 aa, Neisseria gonorrhoeae
VHLAQTERPSIMRIVEKAYTFDDVLLVPAHSTVLPRDVKLQTKLTREITLNLPLLSAAMDTVTEARLAISMAQEGGIGIIHKNMPPEMQARAVSKVKRHESGVVKDPVTVAPTTLIREVLEMRAQRKRKMSGLPVVENGKVVGIVTNRDLRFENRVDLPVSAIMTPRERLVTVPEGTSIDEARELMHTYKVERVLVLNEKDELKGLITIKDILKTTEFPNANKDSEGRLRVGAAVGTGGDTDERVKALVEAGADVIVVDTAHGHSQGVIDRVRWVKETYPHIQVIGGNIATAKAALDLVTVGADAVKVGIGPGSICTTRIVAGVGVPQLTAIHNVAEALKGTGVPLIADGGIRFSGDIAKALAAGAYSVMLGGMFAGTEEAPGEIELYQGRSYKSYRGMGSLGAMSQGSADRYFQDKTDSTDKYVPEGIEGRVPYKGPIVNIIHQLTGGLRSSMGYLGCANIAEMHEKAEFVEITSAGMSESHVHDVQITKEAPNYHR

SEQ ID NO: 5007 - DNA, 153 bp, Neisseria gonorrhoeae
ttgaaagattgcgtttatttccaccgccgttttaaaggccgacggtattcggcagacggggtgcaaacggcgttcagacggcattttcattctttcggcgtgtccgtcagaatggctttgcccgtccgcgcaatcagcccgtgcggcttgcct

SEQ ID NO: 5008 - protein, 51 aa, Neisseria gonorrhoeae
LKDCVYFHRRFKGRRYSADGVQTAFRRHFHSFGVSVRMALPVRAISPCGLP

SEQ ID NO: 5009 - DNA, 201 bp, Neisseria gonorrhoeae
atgaaaatgccgtctgaacgccgtttgcaccccgtctgccgaataccgtcggcctttaaaacggcggtggaaataaacgcaatctttcaatacgggcgtttcgattggtcggaaatgatgcgccggccgccatatcaaaaaatcgggcggcggcttcgggaaagtatgccccgccctccccaagccgccccgtcagcatta

SEQ ID NO: 5010 - protein, 67 aa, Neisseria gonorrhoeae
MKMPSERRLHPVCRIPSAFKTAVEINAIFQYGRFDWSEMMRRPPYQKIGRRLRESMPRPPQAAPSAL

SEQ ID NO: 5011 - DNA, 342 bp, Neisseria gonorrhoeae
ttgcctttccgttttttgaccttaatcggaaccggtttctttgcctttttccccgattcggcaacggcaggcacgccccttccccttactttgccgcatcgggctgtttttttctcggcggtggttttcgatttccctttccccgccgcccctgccggtttggcagatgcggataatttgaccttccgccgcctgccgctttctccggcaattaggacaaagtcgatttttccatcatccaaatcggcacgcgcgacccggacggcaaccctgtcccccatattgaaacggatgccgctgcgttcgccttcgattgccatgatttcggggcggaagttgaaa

SEQ ID NO: 5012 - protein, 114 aa, Neisseria gonorrhoeae
LPFRFLTLIGTGFFAFFPDSATAGTPLPLTLPHRAVFFSAVVFDFPFPAAPAGLADADNLTFRRLPLSPAIRTKSIFPSSKSARATRTATLSPILKRMPLRSPSIAMISGRKLK

SEQ ID NO: 5013 - DNA, 2373 bp, Neisseria gonorrhoeae
atgaataaaaatattaaatctttaaatttacgggaaaaagacccgtttttaagtcgtgaaaaacagcgttatgaacatcctttgcccagtcgggaatggataatcgaattgttggagcgcaaaggtgtgccttcaaaaatcgaatcgcttgcacgcgagctgtcgattacggaagacgagtatgtcttttttgaacgccgtctgaaggcgatggcgcgggacggtcaggttttaatcaaccgccgaggcgcagtttgcgcggcggacaagctggatttggtcaaatgccgcgtcgaggcgcataaggacggtttcggcttcgccgtgccgctcatgccgatggacgaaggggatttcgttttatacgaacgccagatgcgtggtgtcatgcacggcgacaccgttaccgtccgtcctgcgggtatcgaccgcaggggccgccgcgaagggacggttctggatattgtcgaacgcgcgcaaagcaaagttgtcggccgtttctatatggataggggcgtggcgattttggagccggaagacaagcgtctgaaccaaagcatcgtgttggaaccggacggcgtggcgcgtttcaaacccgaatccggtcaggttatcgtcggcaaaattgaggtttatcccgagcaaaaccggcctgcagtggcaaaaatcattgaagttttgggcgattatgccgacagcgggatggaaatcgaaattgccgtgcgcaagcatcatttgccgcaccgattcagtgaagcgtgtgccaaatccgcgaaaaaaattcccgaccatgtacgcaaaagcgatttgaaaggccgcgtcgatttgtgcgaccttcctttggtaacgatagacggcgaaacggcgcgcgatttcgacgacgcggtgtttgccgaaaaagtcggacgcaattaccgcctggtcgtggcgattgcggatgtcagccattatgtccgccctgacgatgcgattgatgcagatgctcaagaacgcagtaccagcgtgtatttcccgcgccgtatgattccgatgctgccggaaaacctgtccaacggcatctgctcgctcaatcccgatgtcgagcgtttgtgtatggtgtgcgatatggtcgttacctatgcgggcaatatcaaagaataccgcttctatcccgccgtgatgcgctctcatgcccgcctgacctacaaccaagtttggaaatggctttcagacggcatcgggaatccgcacaaagcccaaatcgacacgctttacaagctgtttaaaattttgcagaaaaaacgtctggcgcgcggggcggtggagtttgaaagcgtcgaaacccagatgattttcgacgacaacggcaaaatcgaaaaaattgtccccgtcgtccgcaacgatgcccacaagctgattgaagaatgtatgctggcggcgaatgtttgcgcggcggattttctgttgaaaaacaaacatacggctttgttccgcaaccatttgggccccacgcccgaaaaactcgccaccctgcgcgagcagctcggtctgttggggcttcaacttggcggcggcgacaacccgtcgccgaaagactatgccgcgcttgccgaacaattcaaaggcaggccggatgccgaattgctgcaagtcatgatgttgcgctccatgcagcaggcggtttacgaaccgcattgcgaagggcatttcggtttggcttatgaagcatacgcccactttacctcgcccatccgccgctatcccgacctgaccgtccaccgtgccatcaaagccgtattgaaccggaaaacctacacgccaaacaaaagctggcaggctttgggcgtgcatacttcgttttgcgaacgccgtgccgacgatgctggccgcgatgtggaaaactggctgaaaacttattatatgcgcgataaggtcggtgaaatatttgaaggcaaaatctccggggtggcaaattttggaatatttgtcactttggacgatatccatatcgacggtctggtacatatcagcgatttgggcgaagattatttcaacttccgccccgaaatcatggcaatcgaaggcgaacgcagcggcatccgtttcaatatgggggacagggttgccgtccgggtcgcgcgtgccgatttggatgatggaaaaatcgactttgtcctaattgccggagaaagcggcaggcggcggaaggtcaaattatccgcatctgccaaaccggcaggggcggcggggaaagggaaatcgaaaaccaccgccgagaaaaaaacagcccgatgcggcaaagtaaggggaaggggcgtgcctgccgttgccgaatcggggaaaaaggcaaagaaaccggttccgattaaggtcaaaaaacggaaaggcaaatca

SEQ ID NO: 5014 - protein, 791 aa, Neisseria gonorrhoeae
MNKNIKSLNLREKDPFLSREKQRYEHPLPSREWIIELLERKGVPSKIESLARELSITEDEYVFFERRLKAMARDGQVLINRRGAVCAADKLDLVKCRVEAHKDGFGFAVPLMPMDEGDFVLYERQMRGVMHGDTVTVRPAGIDRRGRREGTVLDIVERAQSKVVGRFYMDRGVAILEPEDKRLNQSIVLEPDGVARFKPESGQVIVGKIEVYPEQNRPAVAKIIEVLGDYADSGMEIEIAVRKHHLPHRFSEACAKSAKKIPDHVRKSDLKGRVDLCDLPLVTIDGETARDFDDAVFAEKVGRNYRLVVAIADVSHYVRPDDAIDADAQERSTSVYFPRRMIPMLPENLSNGICSLNPDVERLCMVCDMVVTYAGNIKEYRFYPAVMRSHARLTYNQVWKWLSDGIGNPHKAQIDTLYKLFKILQKKRLARGAVEFESVETQMIFDDNGKIEKIVPVVRNDAHKLIEECMLAANVCAADFLLKNKHTALFRNHLGPTPEKLATLREQLGLLGLQLGGGDNPSPKDYAALAEQFKGRPDAELLQVMMLRSMQQAVYEPHCEGHFGLAYEAYAHFTSPIRRYPDLTVHRAIKAVLNRKTYTPNKSWQALGVHTSFCERRADDAGRDVENWLKTYYMRDKVGEIFEGKISGVANFGIFVTLDDIHIDGLVHISDLGEDYFNFRPEIMAIEGERSGIRFNMGDRVAVRVARADLDDGKIDFVLIAGESGRRRKVKLSASAKPAGAAGKGKSKTTAEKKTARCGKVRGRGVPAVAESGKKAKKPVPIKVKKRKGKS

SEQ ID NO: 5015 - DNA, 267 bp, Neisseria gonorrhoeae
atgttttgcggtatgttttatcctcttcctaagcctgtaaggactcaaaaggcgtatcccttcaaacaatattgttcgacatgctgccgggaaaccgaacccgataccgaaacgcgacggggcgatatgccgctggaaaaatggcggcagtttcttgattggataggaaaaactccgtctgaaacagcttcaagaagccgcaaagcccgtccgaataaaaaataccgtctgaaatttttcagacggcatcgcgtatcatttaaacat

SEQ ID NO: 5016 - protein, 89 aa, Neisseria gonorrhoeae
MFCGMFYPLPKPVRTQKAYPFKQYCSTCCRETEPDTETRRGDMPLEKWRQFLDWIGKTPSETASRSRKARPNKKYRLKFFRRHRVSFKH

SEQ ID NO: 5017 - DNA, 1809 bp, Neisseria gonorrhoeae
atgaaacaaatccgcaacatcgccatcatcgcacacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctgccacatcaatatcgtcgacacgccgggacacgccgacttcggcggcgaagtggagcgcgttttggggatggtggattgcgtcgtcttgttggtggacgcacaggaaggtccgatgccgcaaacccgtttcgtgaccaaaaaagccttggctttggggctgaaaccgattgtcgtcatcaacaaaatcgacaaaccgtccgcccgtccgagctgggttatcgaccagactttcgagttgttcgacaacttgggtgcgaccgacgagcagttggatttcccgattgtttacgcttcaggtttgagcggctttgccaagctggaagaaaccgacgagagcagcgatatgcgcccgctgttcgacaccatcctaaaatacacgcctgcaccgagcggcagcgcggacgagccgctgcaactgcaaatttcccaactcgactacgacaactacaccggccgcctcggtatcggtcgtatcttgaacggacgcatcaaacccggccaaaccgttgccgtgatgaaccacgagcagcaaatcgcccaaggccgcatcaaccagcttttgggtttcaaaggcttggaacgcgtgccgcttgaagaagccgaagccggcgacattgtgattatttccggtatcgaagacatcggcatcggcgtaaccatcaccgacaaagacaaccccaaaggcctgccgatgttgagcgtggacgaaccgacgctgacgatggactttatggtaaacaccagcccgctcgcaggtacagaaggcaaattcgtgaccagccgccaaatccgcgaccgcctgcaaaaagaattgctgaccaacgttgccctgcgcgtggaagacaccgccgatgccgacgtgttccgcgtatccgggcgcggcgaactgcacctgacgattttgctggaaaatatgcgccgcgaaggctacgaactcgccgtcggcaagccgcgcgtcgtgtaccgagacatcgacggtcaaaaatgcgaaccttatgaaaacctgactgtggacgtacccgacgacaaccaaggcgcggtaatggaagaactcggccgccgccgtggcgaactgaccaatatggaaagcgacggcaacggacgcacccgcctcgaataccatattccagcgcgcggcttgatcggtttccaaggcgaattcatgaccctgacgcgcggcgtcgggctgatgagccacgtgttcgacgactacgcgcccgtcaaacccgatatgcccggccgccacaacggcgtactggtgtcccaagagcagggcgaggcggttgcttacgccttgtggaatcttgaagaccgcggccgtatgttcgtatcgcccaacgacaaaatctacgaaggtatgattatcggcatccacagccgcgacaacgatttggtggtcaacccgctcaaaggcaaaaaactcaccaatatccgtgccagcggtaccgacgaagcggtgcgcctgaccacgccgatcaaactgacgctggaaggcgcggtcgagtttatcgacgatgacgagctggtggaaatcacgccgcaatccatccgcctgcgcaagcgttacctgagcgaattggaacgccgccgtcattttaaaaagctggat

SEQ ID NO: 5018 - protein, 603 aa, Neisseria gonorrhoeae
MKQIRNIAIIAHVDHGKTTLVDQLLRQSGTFRANQQVDERVMDSNDLEKERGITILAKNTAIDYEGCHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESSDMRPLFDTILKYTPAPSGSADEPLQLQISQLDYDNYTGRLGIGRILNGRIKPGQTVAVMNHEQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRKRYLSELERRRHFKKLD

SEQ ID NO: 5019 - DNA, 165 bp, Neisseria gonorrhoeae
atggttgattccataactaaaaaagtatcgatcaacccattttacgaggtacggataatgtctgacagctttgaaaacagccccgaatacgatgattggattgaatcgggcggtcgtgatgaagattacgaatactactacaacaaatggcaacgcaggacgcgc

SEQ ID NO: 5020 - protein, 55 aa, Neisseria gonorrhoeae
MVDSITKKVSINPFYEVRIMSDSFENSPEYDDWIESGGRDEDYEYYYNKWQRRTR

SEQ ID NO: 5021 - DNA, 219 bp, Neisseria gonorrhoeae
gtgcaggtgtgccgcctgtgtgtcaaaacatttcccggcgcatcaaaacaaccatttgaccgacaatgcggcttctttgtcgccgtccgtccttttgccgtatccgatgcgtgcggacatatggcctttccaaccggcttcaatgccaaaccgcccttcgagcgccgtcctgcctgccagcgtctgtttttcgccgtccatttccatgccgaaagattt

SEQ ID NO: 5022 - protein, 73 aa, Neisseria gonorrhoeae
VQVCRLCVKTFPGASKQPFDRQCGFFVAVRPFAVSDACGHMAFPTGFNAKPPFERRPACQRLFFAVHFHAERF

SEQ ID NO: 5023 - DNA, 888 bp, Neisseria gonorrhoeae
atgtttcccgttttccatctttcaggcgaaagccgccgccggatgcttcagacggcattgcgttttccccatgttttcaaagcccgtgcggaagattcgcacaaagggactttcggcacgctcgccgtagtcggcggatcggcagggatgagcggcgcgcccgtattggcggcatcggcggcaatgtatctcggctgcggtaaggtgcgggcaggtttcaatcaggatacgctgccttttgccgtcattgccggttttcccgagattatgttggacacggcagacggtttgaccaagcgtcaaggcataaacgcttggacggcgggttgcggcttgggtacagatgcggcggcagtggaaacggtggcggcagtgctggcgcggaatcgagacgaagccgtcgttttggatgcggacgcgctgaacatattatcaaccgatgccgaaacccgaaatctggcgcgcgggtgtaaaaacctgattttaacgccgcaccccgccgaagccgcgcgcctgcttggaacgacagttgcacaggttcaggcggatcggacggcggcagtaaggaagataggggcaattctcggtgcaaccgtggttttaaaggggcacaaaacattggttgccgcgtccgatacggaaatctatgtcaacgaaagcggcaatgcgggattggcaacggcgggcagtggcgacgtattgggcggcatcatcggcagtctgctcgcacagggcgtgccggtttttgaagccgcctgcgcgggcgcgtggctgcacggcgcggcggcggatgttataaaggaatcggcaggcattgcggctgggctgtcggcaggggaaatcgccccggcggcaaggtggctgcgcaactggataactgaaagtatg

SEQ ID NO: 5024 - protein, 296 aa, Neisseria gonorrhoeae
MFPVFHLSGESRRRMLQTALRFPHVFKARAEDSHKGTFGTLAVVGGSAGMSGAPVLAASAAMYLGCGKVRAGFNQDTLPFAVIAGFPEIMLDTADGLTKRQGINAWTAGCGLGTDAAAVETVAAVLARNRDEAVVLDADALNILSTDAETRNLARGCKNLILTPHPAEAARLLGTTVAQVQADRTAAVRKIGAILGATVVLKGHKTLVAASDTEIYVNESGNAGLATAGSGDVLGGIIGSLLAQGVPVFEAACAGAWLHGAAADVIKESAGIAAGLSAGEIAPAARWLRNWITESM

SEQ ID NO: 5025 - DNA, 165 bp, Neisseria gonorrhoeae
atggaaaacgggaaacatttcccctccaatcggttaaaattaaggctcgaaaacaaaccgattctaccgccggaaaccgattatgaaaaacaaaaccaaagtctgggacttccccacccgccttttccactggctgcttgccgcatccctgccctttatgtggta

SEQ ID NO: 5026 - protein, 55 aa, Neisseria gonorrhoeae
MENGKHFPSNRLKLRLENKPILPPETDYEKQNQSLGLPHPPFPLAACRIPALYVV

SEQ ID NO: 5027 - DNA, 579 bp, Neisseria gonorrhoeae
atgtggtatagcgcaaaagccggcggcgatatgctgcaatggcacacgcgcgtcgggctgctcgtccttttcctgctcgtattccgcctctgctggggcatttggggcagcgataccgcccgtttctccagtttcgtccgaggttgggcaggtatacgcggctatctgaaaaacggcattcccgaacatatccagcccggacacaaccccttgggcgcactgatggtcgttgcgcttttggccgccgtctcatttcaagtcggcacggggctttttgccgccaatgaaaacaccttcagcaccaacggctacctcaaccatttggtttccgaacatacgggcagccttatacggaaaatccacctcaactttttcaagctgctcgccgttttttccgcagtccacatcgccgccgtcgccgcataccgcatattcaaaaagaaaaacctcgtccgcccgatgataaccggcttcaaatacatcgaaggcaaaacctcaatccgctttgccggcaaagccgcgcttgccgccgcattatcggttgccgcgcttgccgcagccgccatcctgctcctgtcc

SEQ ID NO: 5028 - protein, 193 aa, Neisseria gonorrhoeae
MWYSAKAGGDMLQWHTRVGLLVLFLLVFRLCWGIWGSDTARFSSFVRGWAGIRGYLKNGIPEHIQPGHNPLGALMVVALLAAVSFQVGTGLFAANENTFSTNGYLNHLVSEHTGSLIRKIHLNFFKLLAVFSAVHIAAVAAYRIFKKKNLVRPMITGFKYIEGKTSIRFAGKAALAAALSVAALAAAAILLLS

SEQ ID NO: 5029 - DNA, 1080 bp, Neisseria gonorrhoeae
gtgaattattttcccattttcgccaacctcgccggccgccccgtattggtcgtaggcggcggcgcggtcgccgcacgcaaaatcagcctgctgctgaaggcgggcgcagaggtcggggttgccgcaaaacacctgaatgccgaactctccgcgttggcggcggaaaacaaaatcctgtggcttgccaaagaatttcgtgccgaacacatccgcacggttttcctcatcattgcggcaagcagcgaccaagccctcaaccggcgcgttttccatcttgccgaaagctgccaaaagccggtcaacgtggtgggcgaccgtgaccattgcagcttcatcttcccgtcggttatcgaccgcgaccctgttcagattgccgtttccagctccggcagcgcgcccgtcctcgcccgcctgctgcgtgaaaggctggaagccttgctgccgccgtctttgggcgatatggcggaaatttcaggaaggtggcgcgatgccggtttttatttccccgtccaactggtcgtccgccaagatgccgacaaggccgacggtttccgaggctatcaggggcgcatcgaacgcggttcggtcaccgtcgggcaaaccgtccgcatcgaaccgaacgggctgaccgccgaagtgtccgaaatcatcgcgccgaaaggggaagtggcgcaggcttttgccggcgaggcggcaaccatccggctggaccgcgacatcgatgtttcgcgcggcgatctttttgtcgataaaaatttcccgctcgccccgcaaaaacatccggaagccacgctttgctggtttgacgaacgcccgctcaacaccgcgcgcaaatacctgctcaagcacggcacgcaaaccgtgtcggcaaaagtcggggaaattgaaagcgttttggatgtccgcacgctggaacaagaggccggcgcggaatccttaaagatgaacgacatcgccaaagtccgcatcaaccttcaaaaacccgttacggcaacgccttatgcggaaaacaccgccgccggttcgtttatcctgatagacgaagcgacatacggtactgttgcggcaggtatgatttta

SEQ ID NO: 5030 - protein, 360 aa, Neisseria gonorrhoeae
VNYFPIFANLAGRPVLVVGGGAVAARKISLLLKAGAEVGVAAKHLNAELSALAAENKILWLAKEFRAEHIRTVFLIIAASSDQALNRRVFHLAESCQKPVNVVGDRDHCSFIFPSVIDRDPVQIAVSSSGSAPVLARLLRERLEALLPPSLGDMAEISGRWRDAGFYFPVQLVVRQDADKADGFRGYQGRIERGSVTVGQTVRIEPNGLTAEVSEIIAPKGEVAQAFAGEAATIRLDRDIDVSRGDLFVDKNFPLAPQKHPEATLCWFDERPLNTARKYLLKHGTQTVSAKVGEIESVLDVRTLEQEAGAESLKMNDIAKVRINLQKPVTATPYAENTAAGSFILIDEATYGTVAAGMIL

SEQ ID NO: 5031 - DNA, 438 bp, Neisseria gonorrhoeae; identical to SEQ ID NO: 767

SEQ ID NO: 5032 - protein, 146 aa, Neisseria gonorrhoeae; identical to SEQ ID NO: 768

SEQ ID NO: 5033 - DNA, 681 bp, Neisseria gonorrhoeae
gtgtcggggctgtccggctacgcttgggcaaaagcaggaaacggggcatccgcagggctgcccgcgcttcagacggcattgccggcggcagaacctttttccgtaaccgtcctttccgcctcgcaaaccggcaatgcgaaatccgttgccgacaaagcggcggacagcctgaaagccgccggcatccaagtcaggcgcgccgaactgaaaggctacaaggcgaaaaacatcgccggcgaacgtcgcctgctgctggttacgtccacccagggcgaaggcgaaccgccggaagaagccgtcgtgctgcacaaactgctgaacggcaaaaaagccccgaaattggacaaactccaatttgccgtactgggtttgggcgacagctcctatccgaatttctgccgggcgggcaaagatttcgacaaacgttttgaagaattgggcgcaaaacgcctgctcgaacgcgttgatgcggatttggactttgccgccgccgcagacggatggacaggccgcattgtcgcgcgcttaaaagaagaagccgcaaaaaaccgggcaacgcccgcgccgcaggcaacgtccccccgccggccttcagacggcatcggagggcaggtactgcaaggcagacccctttcccgccgccctgctggccaatcagaaaatcaccgcccgccaatccga

SEQ ID NO: 5034 - protein, 227 aa, Neisseria gonorrhoeae
VSGLSGYAWAKAGNGASAGLPALQTALPAAEPFSVTVLSASQTGNAKSVADKAADSLKAAGIQVRRAELKGYKAKNIAGERRLLLVTSTQGEGEPPEEAVVLHKLLNGKKAPKLDKLQFAVLGLGDSSYPNFCRAGKDFDKRFEELGAKRLLERVDADLDFAAAADGWTGRIVARLKEEAAKNRATPAPQATSPRRPSDGIGGQVLQGRPLSRRPAGQSENHRPPIR

SEQ ID NO: 5035 - DNA, 1032 bp, Neisseria gonorrhoeae
gtgcgccacatcgaaatcgatttgagcggttcggatttgcactacctcccgggcgacgcgctcggcgtttggtttgacaacgatccggcactggtcggggaaatcctagacctgctcggcatcaatccggcaacggaaatacaggcgggcggaaaaaccctgccggttgcctccgcactgttatcccatttcgaactcacgcaaaacacccccgcctttgtcaaaggctatgccacgttcgccgataatgacgaactcgaccgtattgctgccgacaacgccgttttgcaaggctttgtgcaaagcacgccgattgccggtgtgctgcaccgcttcccggcaaaactgacggcggaacaattcgccggcctgctgcgcccgcttgcgccgcgcctgtattcgatttcctcgtcgcaggcggaagcgggggacgaagtgcacctgaccgtcggcgcagtgcgtttcgaacacgaagggcgcgccagggcgggcggcgcatcgggtttctttgccgaccggctggaagaggacggcacggtgcgcgtgtttgcggaacgcaacgacggcttcaggctgcccgaagacagccgcaagccgattgtgatgatcggctccggtaccggcgtcgcaccgttccgcgccttcgtccaacaacgtgccgcagaaaatgcggaaggcagaaactggctgattttcggcaatccgcattttgccgccgacttcctctatcagaccgaatggcagcagtttgccaaagacggcttcctgcacagatatgacttcgcctggtcgcgcgatcaggaagaaaaaatctatgtgcaggacaaaatccgcgaacaggcggaaggactttggcaatggctgcaggaaggcgcgcatatctatgtgtgcggcgatgcggcaaaaatggcaaaagaagtggaagccgccttgctggatgtgattatcggggcagggcattcggacgaagacggcgcagaaggatatttggatatgctgcgcgaagaaaaacgctatcagcgtgatgtttat

SEQ ID NO: 5036 - protein, 344 aa, Neisseria gonorrhoeae
VRHIEIDLSGSDLHYLPGDALGVWFDNDPALVGEILDLLGINPATEIQAGGKTLPVASALLSHFELTQNTPAFVKGYATFADNDELDRIAADNAVLQGFVQSTPIAGVLHRFPAKLTAEQFAGLLRPLAPRLYSISSSQAEAGDEVHLTVGAVRFEHEGRARAGGASGFFADRLEEDGTVRVFAERNDGFRLPEDSRKPIVMIGSGTGVAPFRAFVQQRAAENAEGRNWLIFGNPHFAADFLYQTEWQQFAKDGFLHRYDFAWSRDQEEKIYVQDKIREQAEGLWQWLQEGAHIYVCGDAAKMAKEVEAALLDVIIGAGHSDEDGAEGYLDMLREEKRYQRDVY

SEQ ID NO: 5037 - DNA, 315 bp, Neisseria gonorrhoeae
ttgattaaatataatcgggaggaacacaaaatgaccgtacaggccaagacaaaaggtttggcgtggcaagaaaagccgctatccgacaacgaacgtctgaaaaccgaaagcaattttttacgcggcacgattttggacgatttgaaagacccgctcacgggcggcttcaaaggcgacaacttccaactcatccgcttccacagtatgtatgagcaggatggccgcgacatccgcaccgaggcaaaactcgagcccttgaaatttatgcttttgcgctgccggctgccggcgggatcatcaaaccgtcccagtgga

SEQ ID NO: 5038 - protein, 105 aa, Neisseria gonorrhoeae
LIKYNREEHKMTVQAKTKGLAWQEKPLSDNERLKTESNFLRGTILDDLKDPLTGGFKGDNFQLIRFHSMYEQDGRDIRTEAKLEPLKFMLLRCRLPAGSSNRPSG

SEQ ID NO: 5039 - DNA, 1395 bp, Neisseria gonorrhoeae
gtgccgaaaaccaagttgcagacgatgccccgcctcttgcacagcctgggtttggattccatcgctacggcggcggatatgaaccgcaatgtgctttgcacctccaacccgatcgagtccgagctgcaccggcaggcttacgaatacgcgaaaaagatttccgaacacctgctgccgcgcacgcgcggttatctggatatgtgggtggacggcaaaaaagttcaaagttccgacgacttccttcaagaaggcgagccgattttgggcaaaacctatctgccgcgaaaattcaaaaccgcagtcgtcatcccgcccttgaacgatgtggactgctacggtaacgatttggatttcgtcgccgtttcagacggcaacggacagcttgccggcttcaatgttttggcgggcggcgggctttcgacggaacacggcaacggcaacaccaaaacctatccgaacatttcactggaactgggtttcgtgcctccggaacacgcactgaaggccgccgaagcggtggtaaccacgcagcgcaacttcggcaaccgcagccaccgcaaaaacgaccgcacccgctacaccattcaaaatatgggcttggacaacttccgcacggaagccgaacgccgtatgggtatgccgttcaaacccatacggccgttcaagtttaccgggcgcggcgaccgcatcggccgggtgaaaggcatagacggcaactggcatttgacccttttcatcgaaagcgggcgtttggttgacgaaggcgggaaacagcttctgaccggcgtgttggaaatcgccaaaatccacaaaggcggcttccgcatcaccgccaaccaaaacctcatcgtggcaaatgtgcccgaaggaggcaaagcccggatcgaacagctcgcccgctcatacgggctgatacgcgacggtgtcagcaagctgcgcgaaaatgcgatgtcgtgcgtttccttcccgacctgcccgctggcaatggcggaagccgaacgcgtgttgccggacttcatcggcgagctggataagattatggcggaacacggcacgtcggacgactacatcgttacccgcattaccggctgcccgaacggctgcggacgggcgatgttggcggaaatcggactggtcggcaaagccgtgggacgctacaacctccacatcggcggcgaccgcgaaggcgtacgcatcccccgcctctacaaagaaaacatcaccctgccggaaatcctttccgaattggaagacctgatcggcaaatgggcggcgggacgcgataccgacgaaggtttcggcgatttcgccatacggacgggcatcgtcaaacccgtgttggatgcgcccgtcgatttttgggacgcatccaaagccgtcccgattgcgcgcgcc

SEQ ID NO: 5040 - protein, 465 aa, Neisseria gonorrhoeae
VPKTKLQTMPRLLHSLGLDSIATAADMNRNVLCTSNPIESELHRQAYEYAKKISEHLLPRTRGYLDMWVDGKKVQSSDDFLQEGEPILGKTYLPRKFKTAVVIPPLNDVDCYGNDLDFVAVSDGNGQLAGFNVLAGGGLSTEHGNGNTKTYPNISLELGFVPPEHALKAAEAVVTTQRNFGNRSHRKNDRTRYTIQNMGLDNFRTEAERRMGMPFKPIRPFKFTGRGDRIGRVKGIDGNWHLTLFIESGRLVDEGGKQLLTGVLEIAKIHKGGFRITANQNLIVANVPEGGKARIEQLARSYGLIRDGVSKLRENAMSCVSFPTCPLAMAEAERVLPDFIGELDKIMAEHGTSDDYIVTRITGCPNGCGRAMLAEIGLVGKAVGRYNLHIGGDREGVRIPRLYKENITLPEILSELEDLIGKWAAGRDTDEGFGDFAIRTGIVKPVLDAPVDFWDASKAVPIARA

SEQ ID NO: 5041 - DNA, 2004 bp, Neisseria gonorrhoeae
atgttcttttttgccgcacgcgtttccattccgcaaaattccgatacttggtataaaatacccccttttcccactctaaaaaaccgtacccgatgccgtctgaaacagccctgcctttcagacggtataggcacaaggaaacacactatgccagaataccgctccaaaacctccacccacggccgcaatatggcgggcgcgcgcgcattgtggcgcgccaccggcgtgatggaaaccgacttcggcaagcccatcatcgccgttgccaactccttcacccaattcgtgccaggccacgtccacctgcacaatatgggccagctggttgcccgcgagattgaaaaagcgggtgcaattgccaaagaattcaacaccatcgccatcgacgacggcatcgccatggggcacagcggtatgttgtactccctgcccagccgcgatttgattgccgactccatcgaatatatggtcaacgcccactgcgccgacgcgctggtgtgcatttccaactgcgacaaaatcaccccgggaatgctgattgccgccatgcgcctgaacatccccaccatcttcgtctccggcggcccgatggaagcgggcaaggtcatcggcgtggcaaacatccaacccgaacgccgtttggacttgattgacgccatgatcgaatcggcggacgacaatgtcagcaaccggcaagtcgaagaagtcgaacaaaacgcctgcccgacctgcggctcgtgttcgggtatgtttacggcaaactcgatgaactgcctgaccgaagcgctcggtctgtccctgcccggcaacggttcgtatttggcgacccacgcaggccgcaaagaattgttcctcgaagcagggcgtatgattgtcgaaatcaccaaacgctattacgagcaagacgacgaaaccgtgctgccgcgcagcattgccaccaaaaaagcgtttgaaaacgccatgacgatggatattgcgatgggaggcagcaccaataccatcctgcacttgctcgccgtcgccaacgaagcgggcgtggatttcaaaatggcagacatcgaccgcttaagccgcgtcgtgccctgcatctgcaaaaccgcgcccaacaaccacgactactatatggaagacgtgcaccgcgccggcggcatcttcgccattctgaaagaacttgacaaagcgggcaaactgcacaccgacgtgtacacgatccacgcgccgacactgaaagacgcgattgaaaaatgggacgtcaccaatcccgaaaacacccgcgccatcgaacgtttcaaagcggctcccggcggcgtgcgcaccactcaggcgttctcgcaaaaccgtatttggaaaaccctcgaccttgaccgcgaaaaaggctgtatccgcgacgtggcacacgcctactcgcaagacggcggtttggcggtcttattcggcaacatcgccgagcgcggctgcgtggtaaaaaccgcaggcgtggacgagagcatcctcaaattcaccggccgcgcgcgcgtgtttgaaagccaggaagccgccgtcgaaggtattttgggcaaccaaatcgtcgccggcaacatcgtcatcatccgctacgaaggcccgaaaggcggcccgggtatgcaggaaatgctatacccgacctcctacctgaaatccaaaggcttgggcaaagcctgcgccctcttaaccgacggacgcttctccggcggcacatcaggtttgtccatcggacacgcctcgcccgaagcggcggaaggcggcgcaatcggtttggtacacgaaggcgatacgattgaaatcgacatccccaaacgcagcatccgccttgtcatttccgatgaagagcttgccgcacgccgtgccgaaatggaagctcgcggcagcaaagcgtggaaaccggaaaaccgcgaccgctacgtctccgccgcattaagggcttacggcgcgatggcgacttccgccgacaaaggcgcggtgcgcgacgtatcgcaaatcgagaga

SEQ ID NO: 5042 - protein, 668 aa, Neisseria gonorrhoeae
MFFFAARVSIPQNSDTWYKIPPFPTLKNRTRCRLKQPCLSDGIGTRKHTMPEYRSKTSTHGRNMAGARALWRATGVMETDFGKPIIAVANSFTQFVPGHVHLHNMGQLVAREIEKAGAIAKEFNTIAIDDGIAMGHSGMLYSLPSRDLIADSIEYMVNAHCADALVCISNCDKITPGMLIAAMRLNIPTIFVSGGPMEAGKVIGVANIQPERRLDLIDAMIESADDNVSNRQVEEVEQNACPTCGSCSGMFTANSMNCLTEALGLSLPGNGSYLATHAGRKELFLEAGRMIVEITKRYYEQDDETVLPRSIATKKAFENAMTMDIAMGGSTNTILHLLAVANEAGVDFKMADIDRLSRVVPCICKTAPNNHDYYMEDVHRAGGIFAILKELDKAGKLHTDVYTIHAPTLKDAIEKWDVTNPENTRAIERFKAAPGGVRTTQAFSQNRIWKTLDLDREKGCIRDVAHAYSQDGGLAVLFGNIAERGCVVKTAGVDESILKFTGRARVFESQEAAVEGILGNQIVAGNIVIIRYEGPKGGPGMQEMLYPTSYLKSKGLGKACALLTDGRFSGGTSGLSIGHASPEAAEGGAIGLVHEGDTIEIDIPKRSIRLVISDEELAARRAEMEARGSKAWKPENRDRYVSAALRAYGAMATSADKGAVRDVSQIER

SEQ ID NO: 5043 - DNA, 159 bp, Neisseria gonorrhoeae; identical to SEQ ID NO: 777

SEQ ID NO: 5044 - protein, 53 aa, Neisseria gonorrhoeae; identical to SEQ ID NO: 778

SEQ ID NO: 5045 - DNA, 273 bp, Neisseria gonorrhoeae
attgaaactctcctgatctaaaaattccaactctatttcccggcaaactatatctatgataaaactggtcggaagattatacctacgccctattaatgccagtgcacctccataatccaagatttcatcatcctgctttaattctccaagctccaaggtattatcgatatctttatcttggttctccgtagcgtatccatagataaatttcagatagctgaactgcttgaatttaatttttacccagtctgtgtaatttggtgtagggcacaa

SEQ ID NO: 5046 - protein, 6 aa, Neisseria gonorrhoeae
IETLLI

SEQ ID NO: 5047 - DNA, 135 bp, Neisseria gonorrhoeae
atgccgatgccgtttgaagggcgttcgggcggcatcgcccgtcgtttgggtggcggtaataaaaaacaaaccggtgttttacaaaccggtttgtcagggtttaatggtcagcgcgtcctgcgttgccatttgttg

SEQ ID NO: 5048 - protein, 45 aa, Neisseria gonorrhoeae
MPMPFEGRSGGIARRLGGGNKKQTGVLQTGLSGFNGQRVLRCHLL

SEQ ID NO: 5049 - DNA, 300 bp, Neisseria gonorrhoeae
atgattattaacaaatttacctgggcgatggcggtattttccgcaattttggccctcgttatcggcagcggctttaccgcgctcgagtatgtaaaagagccgcctgccgccccttatgctgtttccgcgccgaaaaccgccggggtcaagcctcggcgcatcctgccggaacggaatcccccgtgctgccgattgacggttcaaaccccgcgcccgtttcaaacaccggcgatgcggacggacaggatacgcctgacggaaaggcagcagataccgtttccatcatcggggtcggcggca

SEQ ID NO: 5050 - protein, 100 aa, Neisseria gonorrhoeae
MIINKFTWAMAVFSAILALVIGSGFTALEYVKEPPAAPYAVSAPKTAGVKPRRILPERNPPCCRLTVQTPRPFQTPAMRTDRIRLTERQQIPFPSSGSAA

SEQ ID NO: 5051 - DNA, 147 bp, Neisseria gonorrhoeae
atgcatagcatattttggtggtttgcacattttttcggcgtaccgccttcgtcaaacagcgtaccttatgccgccgaccccgatgatggaaacggtatctgctgcctttccgtcaggcgtatcctgtccgtccgcatcgccggtgtt

SEQ ID NO: 5052 - protein, 49 aa, Neisseria gonorrhoeae
MHSIFWWFAHFFGVPPSSNSVPYAADPDDGNGICCLSVRRILSVRIAGV

SEQ ID NO: 5053 - DNA, 771 bp, Neisseria gonorrhoeae
gtgcaaaccaccaaaatatgctatgcattccgaacgccctccgcatacgggcaataccttgccgacgcgggattcgactacctcagcctcgcaaacaaccacagcaacggcttcggcgcgcaaggcatcacggcaacggcaggcaaccttgacgaattgaacatcaaatattcgggcatcgaaaacaggtttgaaaccgccatcctgaagaaaaacggcgtgagatacggcttcgtctccttcgcccccaaccttgccgccgtcaaactgaacgattacgccaaattcaaaaaactgattcggaaaaccaaacaaaaaaccgacatcgtcattgtgatgttccacggcggcgcggaagggaaacaggctgaacacctgccgttcgataccgaaatcttctatggggaaaacaggggcaacgtcgtcgagtttgcgcggctcgccgtcgattccggcgcggatgtcgtattcgggcagggggcgcacgttactcgcgccgtcgaactttaccacgaccgcttcatctcttacagcggcggcaactttgccacctacggcatcagcggcattgcgccgattttcaaaattatcaccgacaaacaggggcggttcgtttccggcaacattatccccatcactcaagtcggcgataaaatccccaaaatcgaccctgaaaaaactgttattgagcggattatttatctgaaccatagcgacttccccaacgggaacggactggatgtctcgcccggcggcgacatcacgcgccgg

SEQ ID NO: 5054 - protein, 257 aa, Neisseria gonorrhoeae
VQTTKICYAFRTPSAYGQYLADAGFDYLSLANNHSNGFGAQGITATAGNLDELNIKYSGIENRFETAILKKNGVRYGFVSFAPNLAAVKLNDYAKFKKLIRKTKQKTDIVIVMFHGGAEGKQAEHLPFDTEIFYGENRGNVVEFARLAVDSGADVVFGQGAHVTRAVELYHDRFISYSGGNFATYGISGIAPIFKIITDKQGRFVSGNIIPITQVGDKIPKIDPEKTVIERIIYLNHSDFPNGNGLDVSPGGDITRR

SEQ ID NO: 5055 - DNA, 1065 bp, Neisseria gonorrhoeae
ttgacgattgaaaaatgccgtctgaaacttgaatgccgtctgaaacctgaaaaaaggctttcagacggcatttgttcggacggaatttccaatatctttttaccggcgcgtgatgtcgccgccgggcgagacatccagtccgttcccgttggggaagtcgctatggttcagataaataatccgctcaataacagttttttcagggtcgattttggggattttatcgccgacttgagtgatggggataatgttgccggaaacgaaccgcccctgtttgtcggtgataattttgaaaatcggcgcaatgccgctgatgccgtaggtggcaaagttgccgccgctgtaagagatgaagcggtcgtggtaaagttcgacggcgcgagtaacgtgcgccccctgcccgaatacgacatccgcgccggaatcgacggcgagccgcgcaaactcgacgacgttgcccctgttttccccatagaagatttcggtatcgaacggcaggtgttcagcctgtttcccttccgcgccgccgtggaacatcacaatgacgatgtcggttttttgtttggttttccgaatcagttttttgaatttggcgtaatcgttcagtttgacggcggcaaggttgggggcgaaggagacgaagccgtatctcacgccgtttttcttcaggatggcggtttcaaacctgttttcgatgcccgaatatttgatgttcaattcgtcaaggttgcctgccgttgccgtgatgccttgcgcgccgaagccgttgctgtggttgtttgcgaggctgaggtagtcgaatcccgcgtcggcaaggtattgcccgtatgcggagggcgttcggaatgcatagcatattttggtggtttgcacattttttcggcgtaccgccttcgtcaaacagcgtaccttatgccgccgaccccgatgatggaaacggtatctgctgcctttccgtcaggcgtatcctgtccgtccgcatcgccggtgtttgaaacgggcgcggggtttgaaccgtcaatcggcagcacgggggattccgttccggcaggatgcgccgaggct

SEQ ID NO: 5056 - protein, 355 aa, Neisseria gonorrhoeae
LTIEKCRLKLECRLKPEKRLSDGICSDGISNIFLPARDVAAGRDIQSVPVGEVAMVQINNPLNNSFFRVDFGDFIADLSDGDNVAGNEPPLFVGDNFENRRNAADAVGGKVAAAVRDEAVVVKFDGASNVRPLPEYDIRAGIDGEPRKLDDVAPVFPIEDFGIERQVFSLFPFRAAVEHHNDDVGFLFGFPNQFFEFGVIVQFDGGKVGGEGDEAVSHAVFLQDGGFKPVFDARIFDVQFVKVACRCRDALRAEAVAVVVCEAEVVESRVGKVLPVCGGRSECIAYFGGLHIFSAYRLRQTAYLMPPTPMMETVSAAFPSGVSCPSASPVFETGAGFEPSIGSTGDSVPAGCAEA

SEQ ID NO: 5057 - DNA, 150 bp, Neisseria gonorrhoeae
ttgcccggctgcgcggcacaaaggcggaaaaaccgtttgccccgtattttcaaacgcgttacacttgccgccgctgttttcagccatttgattacccgcaaccgccgtcattgcgccggcggtttgcctgtcagcgtcattgcgccgctg

SEQ ID NO: 5058 - protein, 50 aa, Neisseria gonorrhoeae
LPGCAAQRRKNRLPRIFKRVTLAAAVFSHLITRNRRHCAGGLPVSVIAPL

SEQ ID NO: 5059 - DNA, 1248 bp, Neisseria gonorrhoeae
atgccgtctgaaagccctttagacggcattgcccggctgcgcggcacaaaggcggaaaaaccgtttgccccgtattttcaaacgcgttacacttgccgccgctgttttcagccatttgattacccgcaaccgccgtcattgcgccggcggtttgcctgtcagcgtcattgcgccgctgtaaatacgaaagaacacattatgaccgtatcccccgtcgccttgcgccgtaagaccgagtgcaagcctcatcccaccgcgcgctattggaaaaaatgcgatgtcgaggcacttttcggactgccgtttttagaacttgtctatcaggcggcagaagtccaccgccaaaatttcaacccgcgcgaaatccagctttccacgctgttgtccatcaaaaccggcggttgtcccgaagattgcgcctactgtccgcaatcagcgcaccacaacaccaatttgggcaaagagcagatgatggatgtggatgaaatcgtcgaaaaagccaaaatcgccaaatcgcgcggcgcaagccggttttgtatgggcgcggcatggcgcggccccaaacccaaagacgtggagacggtttccgcaatcatcaaagccgtcaagggcttaggtatggaaacctgcggcacgttcggtatgctcgaagaaggtatggcggaagacttgaaagaggcgggcttggattattacaaccacaacctcgacaccgaccccgaccgctacaacgacatcatccacacacgccggcacgaagaccgtatggataccttgggcaaagtccgcaacgccggtttgaaagtctgctgcggcggcatcgtcgggatgaacgaaacccgcgccgaacgcgccgggctgattgccagcctcgccaacctcgacccgcagcccgaaagcgtgccgattaaccggttggtcaaagtggaaggcacgccgcttgccgatgccgaagatttggattggaccgaatttgtccgtacggtttccgtagcgcggattacgatgccgcaaagttatgtccgcctctcggcagggcgcagcaatatgcctgaagcgatgcaggcgatgtgcttcatggcgggtgcgaactcgattttttacggcgacaagctgttgaccacaggcaatcctgatgaggacggcgatagaatcctgatggaaaagcttaacctgtatcccttgcagtttgagccggaaggcgaggtcgccgaagtggaaaaagcctccgggattaaagcggattat

SEQ ID NO: 5060 - protein, 416 aa, Neisseria gonorrhoeae
MPSESPLDGIARLRGTKAEKPFAPYFQTRYTCRRCFQPFDYPQPPSLRRRFACQRHCAAVNTKEHIMTVSPVALRRKTECKPHPTARYWKKCDVEALFGLPFLELVYQAAEVHRQNFNPREIQLSTLLSIKTGGCPEDCAYCPQSAHHNTNLGKEQMMDVDEIVEKAKIAKSRGASRFCMGAAWRGPKPKDVETVSAIIKAVKGLGMETCGTFGMLEEGMAEDLKEAGLDYYNHNLDTDPDRYNDIIHTRRHEDRMDTLGKVRNAGLKVCCGGIVGMNETRAERAGLIASLANLDPQPESVPINRLVKVEGTPLADAEDLDWTEFVRTVSVARITMPQSYVRLSAGRSNMPEAMQAMCFMAGANSIFYGDKLLTTGNPDEDGDRILMEKLNLYPLQFEPEGEVAEVEKASGIKADY

SEQ ID NO: 5061 - DNA, 1374 bp, Neisseria gonorrhoeae
atgaaacacatccacattatcggtatcggcggcacgtttatgggcgggattgccgccattgccaaagaagccgggttcaaagtcagcggttgcgacgcgaagatgtatccgccgatgagcacccagctcgaagccttgggcataggcgtacacgaaggcttcgatgccgcgcagttggaagaatttcaagccgatatttacgtcatcggcaatgtcgccaggcgcgggatggatgtggtcgaggcgattttgaaccgtgggctgccttatatttccggcccgcaatggctggctgaaaacgtgctgcaccatcattgggtactcggcgtggcagggacgcacggcaaaacgaccaccgcgtccatgctcgcctgggtcttggaatatgccggactcgcgccgggcttcctcatcggcggtgtaccggaaaatttcggcgtttccgcccgcctaccgcaaacgccgcgtcaagacccgaacagcaaatcgccgtttttcgtcatcgaagccgacgaatacgacaccgcctttttcgacaaacgctccaaattcgtgcattatcgcccgcgtaccgccgtgttgaacaatctggaattcgaccacgccgacatcttcgccgacttgggcgcgatacagacccagttccaccacctcgtgcgcaccgtaccatccgaaggcctcatcgtctgcaacggacagcagcaaagcctgcaagatactttggacaaaggctgctggacgccggtggaaaaattcggcaccggacacggctggcagattggtgaagtcaatgccgacggctcgttcgacgtattgcttgacggcaaaaaagccggacacgtcgcatgggatttgatgggcggacacaaccgcatgaacgcgctcgccgtcatcgctgccgcacgccatgccggagtcgatgttcagacggcctgcgaagccttgggtgcgtttaaaaacgtcaaacgccgcatggaaatcaaaggcacggcaaacggcatcaccgtttacgacgatttcgcccaccacccgaccgccatcgaaaccacgattcaaggtttgcgccaacgtgtcggcggcgcgcgcatcctcgccgtcctcgagccgcgttccaacaccatgaaactcggcacgatgaagtccgccctgcccgcaagcctcaaagaagccgaccaagtgttctgctacgccggcggcgcggactgggacgttgccgaagccctcgcgcctttgggctgcaggctgcgcgtcggtaaagatttcgataccttcgttgccgaaattgtgaaaaacgcccgaaccggcgaccatattttggtgatgagcaacggcggtttcggcggaatacacaccaaactgctggacgctttgaga

SEQ ID NO: 5062 - protein, 458 aa, Neisseria gonorrhoeae
MKHIHIIGIGGTFMGGIAAIAKEAGFKVSGCDAKMYPPMSTQLEALGIGVHEGFDAAQLEEFQADIYVIGNVARRGMDVVEAILNRGLPYISGPQWLAENVLHHHWVLGVAGTHGKTTTASMLAWVLEYAGLAPGFLIGGVPENFGVSARLPQTPRQDPNSKSPFFVIEADEYDTAFFDKRSKFVHYRPRTAVLNNLEFDHADIFADLGAIQTQFHHLVRTVPSEGLIVCNGQQQSLQDTLDKGCWTPVEKFGTGHGWQIGEVNADGSFDVLLDGKKAGHVAWDLMGGHNRMNALAVIAAARHAGVDVQTACEALGAFKNVKRRMEIKGTANGITVYDDFAHHPTAIETTIQGLRQRVGGARILAVLEPRSNTMKLGTMKSALPASLKEADQVFCYAGGADWDVAEALAPLGCRLRVGKDFDTFVAEIVKNARTGDHILVMSNGGFGGIHTKLLDALR

SEQ ID NO: 5063 - DNA, 156 bp, Neisseria gonorrhoeae
atcagttaacgaaccattatattttaaccttaatcccattcgggccagttctgtttcatttggaattcctcttaaatacttattgtttgatgtgccattaatcacaatttctccccctttttttgtaatacgtgctgcttcgggaaaataatccat

SEQ ID NO: 5064 - protein, 5 aa, Neisseria gonorrhoeae
RTIIF

SEQ ID NO: 5065 - DNA, 300 bp, Neisseria gonorrhoeae
gtgtttgacggttttggcaaatggcttgaattatatcgcaaaacggccggtatgtttctatgccgatgccgtttgaagggcgttcgggcggcatcgcccgtcgtttgggtggcggtaataaaaaacaaaccggtgttttacaaaccggtttgtcagggtttaatggtcagcgcgtcctgcgttgccatttgttgtagtagtattcgtaatcttcatcacgaccgcccgattcaatccaatcatcgtattcggggctgttttcaaagctgtcagacattatccgtacctcgtaaaatgggt

SEQ ID NO: 5066 - protein, 100 aa, Neisseria gonorrhoeae
VFDGFGKWLELYRKTAGMFLCRCRLKGVRAASPVVWVAVIKNKPVFYKPVCQGLMVSASCVAICCSSIRNLHHDRPIQSNHRIRGCFQSCQTLSVPRKMG

SEQ ID NO: 5067 - DNA, 186 bp, Neisseria gonorrhoeae
ttgcacaggtcaaaatctttcggcatggaaatggacggcgaaaaacagacgctggcaggcaggacggcgctcgaagggcggtttggcattgaagccggttggaaaggccatatgtccgcacgcatcggatacggcaaaaggacggacggcgacaaagaagccgcattgtcggtcaaatggttgttt

SEQ ID NO: 5068 - protein, 62 aa, Neisseria gonorrhoeae
LHRSKSFGMEMDGEKQTLAGRTALEGRFGIEAGWKGHMSARIGYGKRTDGDKEAALSVKWLF

SEQ ID NO: 5069 - DNA, 303 bp, Neisseria gonorrhoeae
atgcgcgtatctaaaatgattggaagtatattgcttgttgcagcggttcagaccgtattttcggcaaatgtttacgagtgccgccataatggtaaaaccagttacagtcaaactccgggaaaagattgtaccaacgcgggtttggggcgggatcgggtgtacagttcggtcaggcctgccgtgaaagacagggcggaagacgcaggagttggcgattattcggacacggtgagggacgaagccgtccaaaatccgaaagggaatgcacagaaagacggttcggatgccggcatcagaccgcat

SEQ ID NO: 5070 - protein, 101 aa, Neisseria gonorrhoeae
MRVSKMIGSILLVAAVQTVFSANVYECRHNGKTSYSQTPGKDCTNAGLGRDRVYSSVRPAVKDRAEDAGVGDYSDTVRDEAVQNPKGNAQKDGSDAGIRPH

SEQ ID NO: 5071 - DNA, 402 bp, Neisseria gonorrhoeae
ttgattcggtttcaatcaatgcggtctgatgccggcatccgaaccgtctttctgtgcattccctttcggattttggacggcttcgtccctcaccgtgtccgaataatcgccaactcctgcgtcttccgccctgtctttcacggcaggcctgaccgaactgtacacccgatcccgccccaaacccgcgttggtacaatcttttcccggagtttgactgtaactggttttaccattatggcggcactcgtaaacatttgccgaaaatacggtctgaaccgctgcaacaagcaatatacttccaatcattttagatacgcgcatattaaactcctttattgttcctcttcaaaaaaaggaatgtatttcaatagaacttcatctaattctttcattccttgctca

SEQ ID NO: 5072 - protein, 134 aa, Neisseria gonorrhoeae
LIRFQSMRSDAGIRTVFLCIPFRILDGFVPHRVRIIANSCVFRPVFHGRPDRTVHPIPPQTRVGTIFSRSLTVTGFTIMAALVNICRKYGLNRCNKQYTSNHFRYAHIKLLYCSSSKKGMYFNRTSSNSFIPCS

SEQ ID NO: 5073 - DNA, 234 bp, Neisseria gonorrhoeae
ttgctgaatttaccttgttattatgacgaggttttggaaaagcggaaaataccgttcggcaaacaggaaattgatgacgatatggacaaagtgtccgcccttaagcggaagtttaaagacatttctgaaatcaaagtaggggatggttgggaatacccgttcaattatgagcaaggaatgaaagaattagatgaagttctattgaaatacattcctttttttgaagaggaacaa

SEQ ID NO: 5074 - protein, 78 aa, Neisseria gonorrhoeae
LLNLPCYYDEVLEKRKIPFGKQEIDDDMDKVSALKRKFKDISEIKVGDGWEYPFNYEQGMKELDEVLLKYIPFFEEEQ

SEQ ID NO: 5075 - DNA, 108 bp, Neisseria gonorrhoeae
ttgcaagctgcccataaaaaccgattgcctgccaagccgacactacttgttaaagatgccgataatgccgcaactcttccgtatttaccgacaaacgccctatttgct

SEQ ID NO: 5076 - protein, 36 aa, Neisseria gonorrhoeae
LQAAHKNRLPAKPTLLVKDADNAATLPYLPTNALFA

SEQ ID NO: 5077 - DNA, 90 bp, Neisseria gonorrhoeae
ttgttaaagatgccgataatgccgcaactcttccgtatttaccgacaaacgccctatttgcttagagctgttttgtttttcacaaaactt

SEQ ID NO: 5078 - protein, 30 aa, Neisseria gonorrhoeae
LLKMPIMPQLFRIYRQTPYLLRAVLFFTKL

SEQ ID NO: 5079 - DNA, 135 bp, Neisseria gonorrhoeae
ttgagcaatatctgtcaaaaccatttccaccatatccaaaacaaaaccgccgccgccacggcattggacaataagatgagtttccactgcccgtccttccgcaatgccgccttcttgggcttcaaagcacccgca

SEQ ID NO: 5080 - protein, 45 aa, Neisseria gonorrhoeae
LSNICQNHFHHIQNKTAAATALDNKMSFHCPSFRNAAFLGFKAPA

SEQ ID NO: 5081 - DNA, 102 bp, Neisseria gonorrhoeae
ttggatatggtggaaatggttttgacagatattgctcaaaatcgtgctaatggaatccgaacaaataaagaatttggtaaaaaatttgttaaatcaacggat

SEQ ID NO: 5082 - protein, 34 aa, Neisseria gonorrhoeae
LDMVEMVLTDIAQNRANGIRTNKEFGKKFVKSTD

SEQ ID NO: 5083 - DNA, 195 bp, Neisseria gonorrhoeae
atgccgtctgaaaaaatctattacggcgtattgattttcttatgtatcgcttctatgctgctgtcaccgtttttttatgcgggtgctttgaagcccaagaaggcggcattgcggaaggacgggcagtggaaactcatcttattgtccaatgccgtggcggcggcggttttgttttggatatggtggaaatggttt

SEQ ID NO: 5084 - protein, 65 aa, Neisseria gonorrhoeae
MPSEKIYYGVLIFLCIASMLLSPFFYAGALKPKKAALRKDGQWKLILLSNAVAAAVLFWIWWKWF

SEQ ID NO: 5085 - DNA, 783 bp, Neisseria gonorrhoeae
gtgaaacacatcagttcgaccaataatgaacatatcagacacctgcaccgcctgttgtcgcaaggaaagttcagacggcagtatgcccaaaccgttttggagggcgtgcacctgcttcaggttttcctgcaatccggcagaaagccggtcggggtatatattcccgaagctaaaatgccgtctgaagaagtccttaaattgacagcggttttgccggaagacgggattttttccgtttcagacggcatattgaaaaaaatcagcagcttgagttgtgcagacgatatacttacactgattgatatcccattgggcggaaccttgccggacaaaggcgactgtgcggttttggacggcgtgcaagatccgggcaatgtcggcaccgtcttacggagtgcggcggcggcaggggtaggtacggtcgttttgggcaggggttgtgcggacgcgtggtcgcccaaggtattacgcgcgggtatgggcgcgcatttcttgttggacatttattcgcaggcggatttggaaatatggttggcgcactatgaagaccgtgtgtttgccaccgcgttgcgcgaggaaaagcaggcggttttgtacggcgaagatttgtgcgaaccgacagcttgggtgttcggcaacgaaggtgcgggtgtcggtaaagcagttttagacagggcggacaagtgtgtcaggataccgatgcacgatgcaaccgagtctttaaatgtcgcgatggcggcgacaatctgcctgtttgaacagatgcgccaacgggcggcgtat

SEQ ID NO: 5086 - protein, 261 aa, Neisseria gonorrhoeae
VKHISSTNNEHIRHLHRLLSQGKFRRQYAQTVLEGVHLLQVFLQSGRKPVGVYIPEAKMPSEEVLKLTAVLPEDGIFSVSDGILKKISSLSCADDILTLIDIPLGGTLPDKGDCAVLDGVQDPGNVGTVLRSAAAAGVGTVVLGRGCADAWSPKVLRAGMGAHFLLDIYSQADLEIWLAHYEDRVFATALREEKQAVLYGEDLCEPTAWVFGNEGAGVGKAVLDRADKCVRIPMHDATESLNVAMAATICLFEQMRQRAAY

SEQ ID NO: 5087 - DNA, 1053 bp, Neisseria gonorrhoeae
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggttcaaccaacacacagccggcaagcccctccgcatttcaagcgatttcgcacacgttaccgccgaagccgtccgcctgaaccgcctgactcacggcgcactggacgtaaccgtcggccctttggtcaacctttgggggttcggccccgacaaatccgttacccgtgaaccgtcgccggaacaaatcaaacaggcggcatcttatacgggcatagacaaaatcattttgcaacaaggcaaagattacgcttccttgagcaaaacccaccccaaagcctatttggatttatcttcgattgccaaaggcttcggcgttgataaagttgcgggcgaactggaaaaatacggcattcaaaattatctggtcgaaatcggcggcgagttgcacggcaaaggcaaaaatgcgcacggcgaaccgtggcgcatcggtatagagcaacccaatatcatccaaggcggcaatacgcagattatcgtcccgctgaacaaccgttcgcttgccacttccggcgattaccgtattttccacgtcgataaaaacggcaaacgcctctcccacatcatcaatcccaacaacaaacgacccatcagccacaacctcgcctccatcagcgtggtctcagacagtgcaatgacggcggacggtttatccacaggattatttgttttaggcgaaaccgaagccttaaggctggcagaacaagaaaaactcgctgttttcctaattgtccgggataaggacggctaccgcaccgccatgtcttccgaatttgccaagctgctccgc

SEQ ID NO: 5088 - protein, 351 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFNQHTAGKPLRISSDFAHVTAEAVRLNRLTHGALDVTVGPLVNLWGFGPDKSVTREPSPEQIKQAASYTGIDKIILQQGKDYASLSKTHPKAYLDLSSIAKGFGVDKVAGELEKYGIQNYLVEIGGELHGKGKNAHGEPWRIGIEQPNIIQGGNTQIIVPLNNRSLATSGDYRIFHVDKNGKRLSHIINPNNKRPISHNLASISVVSDSAMTADGLSTGLFVLGETEALRLAEQEKLAVFLIVRDKDGYRTAMSSEFAKLLR

SEQ ID NO: 5089 - DNA, 480 bp, Neisseria gonorrhoeae
atgcagttttacctgcaaccgcaggcgcagtttacctacttgggcgtaaacggcggctttaccgacagcgaggggcggcggtcgggctgctcggcagcggtcagtggcaaatccgcgccggcattcgggcaaaaacccgttttgctttgcgtaacggtgtcaatcttcagccttttgccgcttttaatgttttgcacaggtcaaaatctttcggcatggaaatggacggcgaaaaacagacgctggcaggcaggacggcgctcgaagggcggtttggcattgaagccggttggaaaggccatatgtccgcacgcatcggatacggcaaaaggacggacggcgacaaagaagccgcattgtcggtcaaatggttgttttgatgcgccgggaaatgttttgacacacaggcggcacacctgcacggccccgtgcgccgccccgcaaaccgatccgaaccctgccgccccgaagggcggggca

SEQ ID NO: 5090 - protein, 160 aa, Neisseria gonorrhoeae
MQFYLQPQAQFTYLGVNGGFTDSEGRRSGCSAAVSGKSAPAFGQKPVLLCVTVSIFSLLPLLMFCTGQNLSAWKWTAKNRRWQAGRRSKGGLALKPVGKAICPHASDTAKGRTATKKPHCRSNGCFDAPGNVLTHRRHTCTAPCAAPQTDPNPAAPKGGA

SEQ ID NO: 5091 - DNA, 1335 bp, Neisseria gonorrhoeae
ttgctttttctttatcgggatgaagccgtgctgactttagatgcgtttgagcaatgcttgaaggattgttttcctcaaggtctgaatggaaaaaaaacagcagtggcattaagcggcggcttggattccgtcgttttgctgcatctgctggtttgtgccgggaagcgggcaggatttgtgccggaggcattgcacatccatcacggcttgagtccccgagccgacgattgggcggatttctgccggaattattgcgatatgctaggggtggggctggaaacggttaaggtctgcgtggaaaaaaacggtttgggcatcgaggcggcggcaaggcaaaagcgttatgccgagtttgccgaaaaaggctttgacgttttggcgttggcgcaccacagggacgatcaaatcgaaacctttatgctggcagtcgcgcgcggcggaggtttgcgcgctttggcggctatgcccgccgtccgccctttgggggaaaacggcattatctggcggcctttgctgcctttttcgcgccaagacatatgggattatgcccgaaaacacggtttgccgaatatcgaggatgaaagcaataccgatacggcttatttgcgaaaccgcttccggcaccgtattttgcccgaactttcggcgcagattccccatttcgggcggcatgtgctgaacaatgtccgcgctttgcaggaagatttggctttgttggaagaggtcgtcgttcaagactgccgttgggtttgcggggccggttatttcgatacggcgcggtggctgacgttttccccgcgccggaaaacccatattttgcggaattttctaaaggaaaacggcatccccgtgccgaatcagaacgcacttgccgacattgcccgcgttttgacggaggcaaaaaccggacgttggaacttgcaaggctttgaattgcatcattatgcaggcaggctgtttgtgtttgcgtcggaacagttggcaaaaccggcttttctgaaagatgggacgataagcggaaatctcaaaaaaatactgacagaacatagatttgtgttgaagcggcatccgttcggacttcctgaagccatgttggaacaggacgggattttgaggacggtagcggcatcggatacgttggctgtcggcggcatccataaaaatgtgaaaaaaatccttcaggggaaacgggttctgcctttcctgcgcccaatttggccgctcgttgccgacagcggaaaccgtccattggcgttggcaaactgttgtgcggattttcaaatctcggtttcagacggcattttgcccgtacatcctgactttcccattttattt

SEQ ID NO: 5092 - protein, 445 aa, Neisseria gonorrhoeae
LLFLYRDEAVLTLDAFEQCLKDCFPQGLNGKKTAVALSGGLDSVVLLHLLVCAGKRAGFVPEALHIHHGLSPRADDWADFCRNYCDMLGVGLETVKVCVEKNGLGIEAAARQKRYAEFAEKGFDVLALAHHRDDQIETFMLAVARGGGLRALAAMPAVRPLGENGIIWRPLLPFSRQDIWDYARKHGLPNIEDESNTDTAYLRNRFRHRILPELSAQIPHFGRHVLNNVRALQEDLALLEEVVVQDCRWVCGAGYFDTARWLTFSPRRKTHILRNFLKENGIPVPNQNALADIARVLTEAKTGRWNLQGFELHHYAGRLFVFASEQLAKPAFLKDGTISGNLKKILTEHRFVLKRHPFGLPEAMLEQDGILRTVAASDTLAVGGIHKNVKKILQGKRVLPFLRPIWPLVADSGNRPLALANCCADFQISVSDGILPVHPDFPILF

SEQ ID NO: 5093 - DNA, 942 bp, Neisseria gonorrhoeae
ttggattttgaacaacccatagccgaactgaccaacaaaatcgatgagctgcgtttcgtccaagacgagtctgccgtcgatatttcggacgaaatacaccgtttgcagaaaaaaagcaacgatttgaccaaatcgattttcagcaaactcacacccgctcaaatttcacaggtttcccggcatccgcagcgtccctatactttggattacattgacgcgctgtttaccgattttgaagagctgcacggcgaccgccactttgccgacgatcatgcgattgtcggcggattggcgcgtttcaacggacaaagcgttgtggtcgtcgggcatcagaaagggcgcgacaccaaagaaaaaatccgccgcaacttcggtatgccccgtcctgaaggctaccgcaaagccctgcgcctgatgaaaacggcggaaaaattcggcttgcccgtcatgacctttatcgatacgccgggcgcgtatcccggcatcggcgcggaagaacgcgggcagtcggaagccatcggcaaaaacctgtacgaactgacccgactgcgcgttcccgttttgtgtaccgtcatcggcgaaggcggttcgggcggtgcgttggcggtcgccgtaggcgattacgtcaatatgctgcaatattcgacctattccgttatttcccccgaaggctgtgcttcgattttgtggaaaaccgccgaaaaggcggctgatgcggcacaggctttgggtattactgccgaccgcctgcaaaagctggacttggtcgataccgtcattaaagagcctttgggtggtgcgcatagggatttcgggcaaaccatgaaaaacgtaaaagccgttttggaaaaacaactgcacgaagcgcaaagcatcccgcttgccgatttgctttcgcgccgtttcgaccgcattatggcttacggcaaattttcggaacaa

SEQ ID NO: 5094 - protein, 314 aa, Neisseria gonorrhoeae
LDFEQPIAELTNKIDELRFVQDESAVDISDEIHRLQKKSNDLTKSIFSKLTPAQISQVSRHPQRPYTLDYIDALFTDFEELHGDRHFADDHAIVGGLARFNGQSVVVVGHQKGRDTKEKIRRNFGMPRPEGYRKALRLMKTAEKFGLPVMTFIDTPGAYPGIGAEERGQSEAIGKNLYELTRLRVPVLCTVIGEGGSGGALAVAVGDYVNMLQYSTYSVISPEGCASILWKTAEKAADAAQALGITADRLQKLDLVDTVIKEPLGGAHRDFGQTMKNVKAVLEKQLHEAQSIPLADLLSRRFDRIMAYGKFSEQ

SEQ ID NO: 5095 - DNA, 93 bp, Neisseria gonorrhoeae
ttgttcaaaatccaaaaaaacaggtttcataaaatgaagctctcatcaacagattctgccgctatcatacgctatttgtgcatattccgcagt

SEQ ID NO: 5096 - protein, 31 aa, Neisseria gonorrhoeae
LFKIQKNRFHKMKLSSTDSAAIIRYLCIFRS

SEQ ID NO: 5097 - DNA, 399 bp, Neisseria gonorrhoeae
atgaaagacaagcacgattcttccgccatgcggctggacaaatggctttgggcggcacgttttttcaagacccgttcccttgcgcaaaagcatatcgaactgggtagggttcaagtaaacggctcgaaagtcaaaaacagtaaaaccatagacatcggcgatattatcgacctgacgctcaattcccttccccataaaatcaaggttaaaggtttgaaccaccaacgccgcccggcacccgaggcgcggcttctgtatgaagaagacgcgaaaacggcagcattgagggaagagtgcaaacagctcgaccaattcagccgcatcacttccgcccatcccgacggcagaccgaccaagcgcgaccgccgccaactggacaggctgaaaaaaggagactgg

SEQ ID NO: 5098 - protein, 133 aa, Neisseria gonorrhoeae
MKDKHDSSAMRLDKWLWAARFFKTRSLAQKHIELGRVQVNGSKVKNSKTIDIGDIIDLTLNSLPHKIKVKGLNHQRRPAPEARLLYEEDAKTAALREECKQLDQFSRITSAHPDGRPTKRDRRQLDRLKKGDW

SEQ ID NO: 5099 - DNA, 258 bp, Neisseria gonorrhoeae
ttgccaagctgctccgctaaacatacaaaccgattaggaaacaccatgaaaaccctgctcctcaccttcggcatcttcctgaccgtcatcatcggtatggcggtcggctatattttctccaaacgcaccatcaaaggcagttgcggcggcattaccgctttaggtatgaaaaaaatgtgcgactgcgacacaccttgcgacaccctgcaaaaaaagctggatgaagaaaaacaggcaggcggcatacgggttgaccgt

SEQ ID NO: 5100 - protein, 86 aa, Neisseria gonorrhoeae
LPSCSAKHTNRLGNTMKTLLLTFGIFLTVIIGMAVGYIFSKRTIKGSCGGITALGMKKMCDCDTPCDTLQKKLDEEKQAGGIRVDR

SEQ ID NO: 5101 - DNA, 1185 bp, Neisseria gonorrhoeae
acatcccgcctcttccaaaaccgcgcgcgcggccaaatccgccgtatcttttttcaacagcaggtgcaacgccccgaaatcctgttgcagcgcggcaaccttatcggggtgttcgtaccagtccgccaatgccgccgccagtttttccggttttgcttcagattgcaataattccggcacggcctccttacccaacaggatattcggcaggccgacatgcggcactttgattttgcgtttcacataagcataggtcagcggcgaaatcttgtagctgatgaccatcggacgcttgcacaacgccacctccaaagtcgccgtaccgctcgttaccagcaccgcatccgccgccctgcacaccgtttcagactgtctgtcggttaccgtcagcgccaatccggcaaactccggccgctgcaaaacttccgccaaacgccgcttcgtcgcctccgttgcggcaggcagcaggaagcgggcggcgggatagcgttccaacaacaataatgccgtctgaaaaaacaccggcgccatatagtcgatttcgctgacgcggctgccgggcagcagggcgaatacggggatgccgacatccgcgcccaaagttttccgcgccgtttcacggtcgtcttccaagggcataagctgtgccatcggatgaccgacaaactccgcacgtccgcccgcatcgagataaagctgcggctccatcgggaacaggcacagcacgcggttgacctgatgcacgattttgcccacgcgttcgcgccgccacgcccaaaccgacggactgacataatgcagggtcggaatgcccgcccgtttcagcttttccgccacacccagattaaaatcgggcgcatcgataccgacaaagacatcaggtttcaacgacagcaaatcccgtaccagctccctgcgtatccgtaaaatttccggcagccgcctgaccacttcgacaaagccgcgcaccgccagccgctcctgatcataaaggctctcgaaaccttccgccttcatcagttccccgccgatgccggttaaccgtgcctgcgggcaacgctttcggatggcgcgtatcaggtgcgcccccaacaggtcgcccgacgcttcgccgacactgacggcaatcaaagggctttttttatcaaccatattcgtctgtccccacatatagtggattaacaa

SEQ ID NO: 5102 - protein, 56 aa, Neisseria gonorrhoeae
TSRLFQNRARGQIRRIFFQQQVQRPEILLQRGNLIGVFVPVRQCRRQFFRFCFRLQ

SEQ ID NO: 5103 - DNA, 471 bp, Neisseria gonorrhoeae
gtgcttctgtttgcagcgggaatggttttaccagtctccttttttcagcctgtccagttggcggcggtcgcgcttggtcggtctgccgtcgggatgggcggaagtgatgcggctgaattggtcgagctgtttgcactcttccctcaatgctgccgttttcgcgtcttcttcatacagaagccgcgcctcgggtgccgggcggcgttggtggttcaaacctttaaccttgattttatggggaagggaattgagcgtcaggtcgataatatcgccgatgtctatggttttactgtttttgactttcgagccgtttacttgaaccctacccagttcgatatgcttttgcgcaagggaacgggtcttgaaaaaacgtgccgcccaaagccatttgtccagccgcatggcggaagaatcgtgcttgtctttcatacgattttgtttgaaataattgaatttgtttcgagtttagca

SEQ ID NO: 5104 - protein, 157 aa, Neisseria gonorrhoeae
VLLFAAGMVLPVSFFQPVQLAAVALGRSAVGMGGSDAAELVELFALFPQCCRFRVFFIQKPRLGCRAALVVQTFNLDFMGKGIERQVDNIADVYGFTVFDFRAVYLNPTQFDMLLRKGTGLEKTCRPKPFVQPHGGRIVLVFHTILFEIIEFVSSLA

SEQ ID NO: 5105 - DNA, 195 bp, Neisseria gonorrhoeae
atgaaatggaccgatacccggcgcatcgccgaagaactctacgacctgcacggcgaagccatcgatcccaaaaccgtgcgctttacccaactgcgcgacctgattatggcattgcccgaatttgacgacgatcccgcccgttgcggcgaacgcatccttgaagccgtgcagcaggcatggatagacgaggcggaa

SEQ ID NO: 5106 - protein, 65 aa, Neisseria gonorrhoeae
MKWTDTRRIAEELYDLHGEAIDPKTVRFTQLRDLIMALPEFDDDPARCGERILEAVQQAWIDEAE

SEQ ID NO: 5107 - DNA, 354 bp, Neisseria gonorrhoeae
atgttgcccgtccaatatttgatacagtttgcgtatcagcagaatcaggcggtcaaactcctccatctccgacagggagtcgggatggtcggaagcggtataaaccagttcggacaattttgcggcaaacatattgttcatcaatcttccttatcggttgaaaccccgctcttcagggcggtagaatcagatttgtttgggaggggtaactcctcccggatcaggacgacacataaggtggtgcttgatgtgccgtccggcgagttgaaacattcagccatcctcaaggggcggcagttttgccgaaacatattctacacggcttcaatgccggacgataaaaggaaatttata

SEQ ID NO: 5108 - protein, 118 aa, Neisseria gonorrhoeae
MLPVQYLIQFAYQQNQAVKLLHLRQGVGMVGSGINQFGQFCGKHIVHQSSLSVETPLFRAVESDLFGRGNSSRIRTTHKVVLDVPSGELKHSAILKGRQFCRNIFYTASMPDDKRKFI

SEQ ID NO: 5109 - DNA, 270 bp, Neisseria gonorrhoeae
ttgcggaacgcctttccgagtcggtcgggcggcttcacggttgcggcagaaagcgtgtccgccgcctgccccgagcttgaaggacgctatctcgaccttgtccgccgcgccgccgtctctttcggtttcgcgcaaggacaggcaaatccggcaggcgggcaggaagaaacgcaagccgcctcagatgccgtatcgggtcgttccgtcaaaaaaccgataaaaatcaatatagaatcgaaagttccgtcttcacaaacgtctgtttttcgg

SEQ ID NO: 5110 - protein, 90 aa, Neisseria gonorrhoeae
LRNAFPSRSGGFTVAAESVSAACPELEGRYLDLVRRAAVSFGFAQGQANPAGGQEETQAASDAVSGRSVKKPIKINIESKVPSSQTSVFR

SEQ ID NO: 5111 - DNA, 576 bp, Neisseria gonorrhoeae
atgagcgaacagacacagcagcaaaacagtgaagaagcggttgaaaatgtggaggcggtggaaaccgtcgagacagtaggaaatgcggacggtgtacaggaacaggctgccgccgagccggcttatgaggatttgcaggcgcggattgccgagctggaagcgcagttgaaagacgaacaactgcgcgctttggcaaacgagcaaaacctgcgccgccgccaccagcaggaaattgccgatacgcacaagttcgccggacagaagtttgccgtggaaatgttgccggtcaaggattatctggaaatggcgcttttggatcagagcggtaatttcgatgcgctgaaaatgggtgtgcagatgactttgaatgagttgcagaaggcgtttgatgccacgcaaatcaaggaaatcaatcctaaagcgggcgataagctcgatccgaatatccatcaggcgatgcaggcggtggccagtgagcaggaacccaataccgtggttggtgtgatgaagaagggttataccctgtccgaccgtgtgttgcgcccggctatggttacggtggcacggaaggaagcc

SEQ ID NO: 5112 - protein, 192 aa, Neisseria gonorrhoeae
MSEQTQQQNSEEAVENVEAVETVETVGNADGVQEQAAAEPAYEDLQARIAELEAQLKDEQLRALANEQNLRRRHQQEIADTHKFAGQKFAVEMLPVKDYLEMALLDQSGNFDALKMGVQMTLNELQKAFDATQIKEINPKAGDKLDPNIHQAMQAVASEQEPNTVVGVMKKGYTLSDRVLRPAMVTVARKEA

SEQ ID NO: 5113 - DNA, 477 bp, Neisseria gonorrhoeae
gtgtcttttgattgcttcggtgctttcagttatcagcccggttcggatactcgtcctacaaatgttggcgatactgccgatttttcattttcagacaagccggcaaacggtgttttccattatttctccagcggtaaaaccgatcaaaaatcatctgaagccttgtatgacgaaatcaatattacgggtaaaaactacaatagcggcatcctcgccgtcgataatatgcctgttgttaagaaatatattacagataattaccgaactgatttaaagcaggcagttaaaaagcaattacaggatttatacaaaacaagacccgaggcttgggaagaaaataaaaaacgggttagggaagagataataaagcagtttggaatttctgaagatgtgtttaataaacttcaacagaaaatgcctcaaaagattaattctttaatagaagaacaggtactcactccttatatattgcgtccc

SEQ ID NO: 5114 - protein, 159 aa, Neisseria gonorrhoeae
VSFDCFGAFSYQPGSDTRPTNVGDTADFSFSDKPANGVFHYFSSGKTDQKSSEALYDEINITGKNYNSGILAVDNMPVVKKYITDNYRTDLKQAVKKQLQDLYKTRPEAWEENKKRVREEIIKQFGISEDVFNKLQQKMPQKINSLIEEQVLTPYILRP

SEQ ID NO: 5115 - DNA, 426 bp, Neisseria gonorrhoeae
atgttgccgacctgctcgaaccgcgacattaggcagacagttttcctaaaaacggacacaaatactttttacagaaagacaataaaaatgcccaaaatcaccgtacttccacacgcaacattatgccccgagggtgcagtcatcgataacgcgcccgaaggcaaaaccgtcctcgacgtgctgctcgaccacgacatcgaagtcgatcacgcctgcgaaaaatcctgcgcctgcaccacctgccacgtgattatccgcaaaggtttcgacagtttggaagagccggccgaattggaagaagacctgctcgatcaggcttggggtttggaagccgattcgcgcctgagttgtcaggcggttgttgccggcgaggatttgattgtggaaatccccaaatacaccatcaaccacgcgcgcgaagaacac

SEQ ID NO: 5116 - protein, 142 aa, Neisseria gonorrhoeae
MLPTCSNRDIRQTVFLKTDTNTFYRKTIKMPKITVLPHATLCPEGAVIDNAPEGKTVLDVLLDHDIEVDHACEKSCACTTCHVIIRKGFDSLEEPAELEEDLLDQAWGLEADSRLSCQAVVAGEDLIVEIPKYTINHAREEH

SEQ ID NO: 5117 - DNA, 771 bp, Neisseria gonorrhoeae
ttgaggagcagtatgatgggcgattccgtcatttattatgtagaacaggcagacgaaccggtaaaccgtgccggcgaacgcgcccgtaaaacattcaaatacttttggcgcgagcttttttgggaacgccgccgcattatttccgccttggattttgccatggtcaaagtcccttttttccaagacggcgaagacggcgaaatttgcgaacatatgtggatcgacgatatttattttgacggtctttatatttacggtgtgctgaacaatgaacccggcggactgaccaatgtcgaacaaggcgaaagcgtttgcgttccggttggcgacatcagcgactggatgttcgtgtgcaacggcatcccctacggcggctttaccgtacaggcaatgcgcggacagatgacggaagaggagcgtaccgaacacgataccgcctggggaatcgatttcggcgatcccgggcaggtattgccggtgtatgaagaaaaagaacatcccgaaaatttggaagagcatccgatgtgccggaactgtattgacgattttcggcaacagttgtcccaaaatccggattttctgcatgagcaggacgaagacggctatacgccgcttcatcatgaagccatggcaggaaatgcacttatggttcaagccatgcttgaatacggcgcaaatcctgcctcaaagacatcggaaggctataccgccctcgattttgcccgcctgacgggctggcaaaatgttgccgacctgctcgaaccgcgacat

SEQ ID NO: 5118 - protein, 257 aa, Neisseria gonorrhoeae
LRSSMMGDSVIYYVEQADEPVNRAGERARKTFKYFWRELFWERRRIISALDFAMVKVPFFQDGEDGEICEHMWIDDIYFDGLYIYGVLNNEPGGLTNVEQGESVCVPVGDISDWMFVCNGIPYGGFTVQAMRGQMTEEERTEHDTAWGIDFGDPGQVLPVYEEKEHPENLEEHPMCRNCIDDFRQQLSQNPDFLHEQDEDGYTPLHHEAMAGNALMVQAMLEYGANPASKTSEGYTALDFARLTGWQNVADLLEPRH

SEQ ID NO: 5119 - DNA, 738 bp, Neisseria gonorrhoeae
ttgaaccataagtgcatttcctgccatggcttcatgatgaagcggcgtatagccgtcttcgtcctgctcatgcagaaaatccggattttgggacaactgttgccgaaaatcgtcaatacagttccggcacatcggatgctcttccaaattttcgggatgttctttttcttcatacaccggcaatacctgcccgggatcgccgaaatcgattccccaggcggtatcgtgttcggtacgctcctcttccgtcatctgtccgcgcattgcctgtacggtaaagccgccgtaggggatgccgttgcacacgaacatccagtcgctgatgtcgccaaccggaacgcaaacgctttcgccttgttcgacattggtcagtccgccgggttcattgttcagcacaccgtaaatataaagaccgtcaaaataaatatcgtcgatccacatatgttcgcaaatttcgccgtcttcgccgtcttggaaaaaagggactttgaccatggcaaaatccaaggcggaaataatgcggcggcgttcccaaaaaagctcgcgccaaaagtatttgaatgttttacgggcgcgttcgccggcacggtttaccggttcgtctgcctgttctacataataaatgacggaatcgcccatcatactgctcctcaacgtgtacggtatctgtttgcaccttaccgcggttttctacctccggcatccgattcggatttgaaaagttccaaatattcggaa

SEQ ID NO: 5120 - protein, 246 aa, Neisseria gonorrhoeae
LNHKCISCHGFMMKRRIAVFVLLMQKIRILGQLLPKIVNTVPAHRMLFQIFGMFFFFIHRQYLPGIAEIDSPGGIVFGTLLFRHLSAHCLYGKAAVGDAVAHEHPVADVANRNANAFALFDIGQSAGFIVQHTVNIKTVKINIVDPHMFANFAVFAVLEKRDFDHGKIQGGNNAAAFPKKLAPKVFECFTGAFAGTVYRFVCLFYIINDGIAHHTAPQRVRYLFAPYRGFLPPASDSDLKSSKYSE

SEQ ID NO: 5121 - DNA, 561 bp, Neisseria gonorrhoeae
atgcgccatttggaaaacaacggctatgcgaacgttgccgggttggaacgcatcctcgccgtcaaaaccgacaattacaaagaaaaagaaaacctgctccatgaaattttcagcaaaagcaggataggcgataccgaattgttcgccgtggacgaaaaccttgtaaaacgtttgtttttatcgcttcgcggcgaaatcgtgttcccgaaaaacgaaacggcggaatcggaatttgaaaaaagcgtccacgaacgcaggcaggaagggaatgccggatccggccgcaaacaactgcttgatttggtacggcgcggacaccgggaatacccttacgcgctgccccggcttttggcggacgcggcatcctacaagccgaaaaaatcgaaaatccgcctttttaaagaagcatatttcggcaaaagcggcacgaggctgaccgacgaaattgcagacggcatccatatttacacctgtttttcgcgggcggatttggaaaaagcctattccgaatatttggaacttttcaaatccgaatcggatgccggaggtagaaaaccgcgg

SEQ ID NO: 5122 - protein, 187 aa, Neisseria gonorrhoeae
MRHLENNGYANVAGLERILAVKTDNYKEKENLLHEIFSKSRIGDTELFAVDENLVKRLFLSLRGEIVFPKNETAESEFEKSVHERRQEGNAGSGRKQLLDLVRRGHREYPYALPRLLADAASYKPKKSKIRLFKEAYFGKSGTRLTDEIADGIHIYTCFSRADLEKAYSEYLELFKSESDAGGRKPR

SEQ ID NO: 5123 - DNA, 159 bp, Neisseria gonorrhoeae
ttgaaaaacatcgatatggaaaaatcaggcattgtctattcgatgaaaaccgtcatcaagggcgtgtatagtgaattaaatttaaaccggtacggcgttggctcgccttgccgtactatttgtactgtctgcggctcgccgccttgtcctgatttttgt

SEQ ID NO: 5124 - protein, 53 aa, Neisseria gonorrhoeae
LKNIDMEKSGIVYSMKTVIKGVYSELNLNRYGVGSPCRTICTVCGSPPCPDFC

SEQ ID NO: 5125 - DNA, 2016 bp, Neisseria gonorrhoeae
atgatgggagggaaaggcggattttatcggtatttggcggtagagggcaatttcggcggcacggcccaatccttagcggtttgctcaactatcggcgcaaattctgttaaaatgccgccttccttcctttacacaccgcaccgacaggcagaatttatggctcttttgcagatttcagaaccgggtatgtccgccgccccgcaccggcaccgtttggcggcaggcatcgatttgggtacgaccaacagcttggtcgccaccgtccgcagcggcagtgccgcctgcctgcccgatgccgacgggcgcgttaccctgccttccgtcgtccgctatctggaaaacggcggcattgaagtcggcaaaaccgccctgtccgcccaaaaaaccgacccgctgaacaccgtcagctccgccaaacgccttatcgggcggactcttgccgatctgcatcaaaatacgcattacctgccttaccgtttcggcgacaatcaacgctttatcgaactgcatacgcggcagggggtgaaaacgcctgtcgaagtgtcggcggaaatcctcaaaaccctcaaattgcgtgccgaagaaaccttgggcggcgatttggtcggcgtggtgattaccgtccccgcctatttcgacgacgcgcaacgccaggccaccaaagatgccgcgcgtctggccggtttgaacgtattgcgcctgctcaacgaacctaccgccgccgcaatcgcctacgggctggacaacgcctcggaaggcacgtttgtcgtgtacgatttgggcggcggcacattcgacgtatccgtgttgcaactgaccaaaggactgtttgaagtcaaagccaccggcggcaacagcgcgttgggcggcgatgacttcgaccatcgtttgttctgctacctgctcgaacaaaacagactctcccaactcaacgaacaagacagccaactcctgctctcgctcgtccgcgccgccaaagaacaattgaccacgcaaaccgaagcgcgcattcaggcgacgctttcagacggtatggcaatcgacacaagcatcagtcgcgccgagttccacaacctgacgcagcatttggtgatgaaaacgctcgagccggtcaaacaggcgttgaaagatgccggtgtcggtaaaaacgaagtcaaaggcgtggttatggtcggcggttcgacccgtatgccgcacgtccaacaggcagtcgccacctttttcggacaaaccccgctgaacaacctcaatcccgacgaagtcgtcgcgctcggcgcagccatacaggcaaacgtcctcgcaggcaacaaagccgacggcgaatggctgctgttggacgttacccccttgtcgctcggtttggaaacctacggcggcttggcggaaaaaatcatcccgcgcaattccaccatccccaccgcgcgcgcgcaggactttaccaccttcaaagacggtcagaccgcgatgacgatacacgtcgtgcaaggcgaacgcgagctcgtttccgactgccgcagccttgccaaatttaccctgcgcggcattccgcctatggcggcgggtgcggcgcgtatccgcgttaccttccaaatcgatgccgacggtttgctgtccgtttccgcccaagaacaaagcaccggcgtacaggcgcaaatcgaagtcaaaccctcctacggtttggacgatgacaccatcacccaaatgctcaaagacagcatgggcaacgccgccgaagatatggcggcccgcgcccgcgccgaagccgtggtcgaagccgaaagcctgaccgatgccgtcaacgccgccctcgagttggacagcgatttgctggatgccgaagagtttgcacaaatccagcgagacatcgccgatttgcaaggccgtctgaaagacggtaaagctgaagacatccgtgcagctgtcgccaaactcagccgcagcaccgacaatttcgccgccaagcgcatgaaccgcaacatccaacgtgcgctgacaggtcagagtgtcgataatatt

SEQ ID NO: 5126 - protein, 672 aa, Neisseria gonorrhoeae
MMGGKGGFYRYLAVEGNFGGTAQSLAVCSTIGANSVKMPPSFLYTPHRQAEFMALLQISEPGMSAAPHRHRLAAGIDLGTTNSLVATVRSGSAACLPDADGRVTLPSVVRYLENGGIEVGKTALSAQKTDPLNTVSSAKRLIGRTLADLHQNTHYLPYRFGDNQRFIELHTRQGVKTPVEVSAEILKTLKLRAEETLGGDLVGVVITVPAYFDDAQRQATKDAARLAGLNVLRLLNEPTAAAIAYGLDNASEGTFVVYDLGGGTFDVSVLQLTKGLFEVKATGGNSALGGDDFDHRLFCYLLEQNRLSQLNEQDSQLLLSLVRAAKEQLTTQTEARIQATLSDGMAIDTSISRAEFHNLTQHLVMKTLEPVKQALKDAGVGKNEVKGVVMVGGSTRMPHVQQAVATFFGQTPLNNLNPDEVVALGAAIQANVLAGNKADGEWLLLDVTPLSLGLETYGGLAEKIIPRNSTIPTARAQDFTTFKDGQTAMTIHVVQGERELVSDCRSLAKFTLRGIPPMAAGAARIRVTFQIDADGLLSVSAQEQSTGVQAQIEVKPSYGLDDDTITQMLKDSMGNAAEDMAARARAEAVVEAESLTDAVNAALELDSDLLDAEEFAQIQRDIADLQGRLKDGKAEDIRAAVAKLSRSTDNFAAKRMNRNIQRALTGQSVDNI

SEQ ID NO: 5127 - DNA, 870 bp, Neisseria gonorrhoeae
gtgaaaggactcgactattgccgccaaaaagcagaggaaagccgctccagttttttgtcgggcttccgtttcctgactcaggaaaaacaggatgcggtaacggttctgtatgccttttgccgcgaattggacgatgtggttgacgaatgttccaaccccgatgttgcacaggcaacattgaactggtggcgcggcgatttggacaatgcgttcggcggcgcgatgccggaacaccccgtcaatcaggccttgcggcaggttaaggaaaccttcaagctgccgaaatatgaactggaagccttaatcgacgggatgcagatggatttggttcaggcgcgttacggcagttttgaggaattgaaactgtattgccgccgcgtcgcgggcgtggtcggctgcctgattgcgcggattttggggttttcagacggcaaaacgctggaatacgcggataaaatgggtcttgcgctgcaactgaccaacatcatccgcgatgtcggcgaagatgcgcgcaggggacggatttacctgccgatggaggaaatgcagcggtttgacgtacccgcaagcgtgattttgcaatgcagcccgacgggcaattttgccgaattgatggcgttccaaatcaaacgcgcccgtgaaacctaccgcgaagccgtatcgctgctgcctgatgccgataaaaaagcccaaaaagtcggactggttatggcggcggtttattacgcgctgttgaacgaaatcgaccgagacggcgcgcaaaacgtcctcaaatacaaaatcgccctcccttcgccgcgcaaaaaacgcattgccctgaaaacctggttattcggattcaaaccgcgccccggcacgccggaacgggca

SEQ ID NO: 5128 - protein, 290 aa, Neisseria gonorrhoeae
VKGLDYCRQKAEESRSSFLSGFRFLTQEKQDAVTVLYAFCRELDDVVDECSNPDVAQATLNWWRGDLDNAFGGAMPEHPVNQALRQVKETFKLPKYELEALIDGMQMDLVQARYGSFEELKLYCRRVAGVVGCLIARILGFSDGKTLEYADKMGLALQLTNIIRDVGEDARRGRIYLPMEEMQRFDVPASVILQCSPTGNFAELMAFQIKRARETYREAVSLLPDADKKAQKVGLVMAAVYYALLNEIDRDGAQNVLKYKIALPSPRKKRIALKTWLFGFKPRPGTPERA

SEQ ID NO: 5129 - DNA, 831 bp, Neisseria gonorrhoeae
atgccgcctgaagcccggccggcgggttcagacggcattgccgctttacttcgatcggtttatacgcaaaacgcgcttcaggaaataaatcagattattccccagacgccttcaggcttccttccgtgccaccgtaaccatagccgggcgcaacacacggtcggacagggtataacccttcttcatcacaccaaccacggtattgggttcctgctcactggccaccgcctgcatcgcctgatggatattcggatcgagcttatcgcccgctttaggattgatttccttgatttgcgtggcatcaaacgccttctgcaactcattcaaagtcatctgcacacccattttcagcgcatcgaaattaccgctctgatccaaaagcgccatttccagataatccttgaccggcaacatttccacggcaaacttctgtccggcgaacttgtgcgtatcggcaatttcctgctggtggcggcggcgcaggttttgctcgtttgccaaagcgcgcagttgttcgtctttcaactgcgcttccagctcggcaatccgcgcctgcaaatcctcataagccggctcggcggcagcctgttcctgtacaccgtccgcatttcctactgtctcgacggtttccaccgcctccacattttcaaccgcttcttcactgttttgctgctgtgtctgttcgctcatatcgtatccctcaaaacaaattggaaatcaaaatccggttattacccgagcaagataaggacattttcaagaaacttcaagcaaaggcaggaaatttcacatccgccgccgaataccctaccgcaaaaaccatataaacgg

SEQ ID NO: 5130 - protein, 277 aa, Neisseria gonorrhoeae
MPPEARPAGSDGIAALLRSVYTQNALQEINQIIPQTPSGFLPCHRNHSRAQHTVGQGITLLHHTNHGIGFLLTGHRLHRLMDIRIELIARFRIDFLDLRGIKRLLQLIQSHLHTHFQRIEITALIQKRHFQIILDRQHFHGKLLSGELVRIGNFLLVAAAQVLLVCQSAQLFVFQLRFQLGNPRLQILISRLGGSLFLYTVRISYCLDGFHRLHIFNRFFTVLLLCLFAHIVSLKTNWKSKSGYYPSKIRTFSRNFKQRQEISHPPPNTLPQKPYKR

SEQ ID NO: 5131 - DNA, 153 bp, Neisseria gonorrhoeae
ttgtttttaatctcggcttctttgacgggatcgtacgcatccgaaccccaagcatatggcgtgcaaaacagcgataaaacagataatgttaatagattaacccgaccgcttgcttgctttcagtgtcatgagaaattttcctttgtcaagtgt

SEQ ID NO: 5132 - protein, 51 aa, Neisseria gonorrhoeae
LFLISASLTGSYASEPQAYGVQNSDKTDNVNRLTRPLACFQCHEKFSFVKC

SEQ ID NO: 5133 - DNA, 1371 bp, Neisseria gonorrhoeae
atgatgaacacgccgcatccgcgcccgaaaatcgccgtcatcggcgcaggctgggccggcttgtccgccgccgtcaccttggcgcggcacgccgacgttaccctgtttgaagccggccggcaggcgggcggaagggcgcgcacactggccggaaataccgacggtttcggttttttggacaacgggcagcacattttgctcggcgcataccggggcgtgttgcgcctgatgaaaaccatcggttcagacccccgtgccgcctttttgcgcgtaccgctgcactggcatatgcacggcggtttgcagttccgcgccctccccctgcccgcgccgctgcatattttgggcggcgtgctgcttgcccggcgcgtaccgtccgcattcaaagccaaactgcttgccgatatgtccgatttgcagaagtccgcacgcctcggacagcccgacacgacagttgcacaatggctgaaacagcggaacgtgccgcgtgccgccgtaatgcagttttggcagcccttggtctggggcgcgctcaacacgcctttggaaaccgcaagcctgcgcgtgttgtgcaacgttttgtccgacggcgtgctgacgaaaaaatccggcagcgactatctcctacccaaacaggatttgggcgcaatcgtcgccgaacccgccttggcggagcttcaacggctcggcgcggacatccgcctcgaaacgcgcgtatgccgtctgaacaccctcccggacggaaaagtcctcgtcaacggcgaagccttcgatgccgccatacttgccaccgcgccctaccacgccgccgcgctcctgcccgaaggcacgcccgaacacgttcagacggcatatcaaaaccttcgctaccacgccatcaccaccgtctatctgcgctacgccgaacccgtccgcctgcccgccccgctgaccggcattgccgacggcacggcacaatggctgctttgccggggcaggctcggactgcccgaaaacgaagtctccgccgtcattagcgtttccgaccgcgtcggcgcgtttgcaaaccgggcgtgggcggacaaagcccacgccgacctcaaacgcatccttccgcatttgggcgaacccgaagccgtgcgcgtcatcaccgaaaaacgcgccacaaccgcaaccgatgcccctccgccggatttgtcgtggctgcaccggcaccgtatcttccccaccggcgactacctccacccgcactaccccgccacgctcgaagcctgccgtacaatcaggtttcgcgtcggcggaagcctgcctgcaaagcctgaacgatgccgtctgaaaacgccggccggcatcgggacgctttacaaggtgcggcaaaacgctaaaatacat

SEQ ID NO: 5134 - protein, 457 aa, Neisseria gonorrhoeae
MMNTPHPRPKIAVIGAGWAGLSAAVTLARHADVTLFEAGRQAGGRARTLAGNTDGFGFLDNGQHILLGAYRGVLRLMKTIGSDPRAAFLRVPLHWHMHGGLQFRALPLPAPLHILGGVLLARRVPSAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALAELQRLGADIRLETRVCRLNTLPDGKVLVNGEAFDAAILATAPYHAAALLPEGTPEHVQTAYQNLRYHAITTVYLRYAEPVRLPAPLTGIADGTAQWLLCRGRLGLPENEVSAVISVSDRVGAFANRAWADKAHADLKRILPHLGEPEAVRVITEKRATTATDAPPPDLSWLHRHRIFPTGDYLHPHYPATLEACRTIRFRVGGSLPAKPERCRLKTPAGIGTLYKVRQNAKIH

SEQ ID NO: 5135 - DNA, 717 bp, Neisseria gonorrhoeae
atgccgacactgaccgacaaaaccatcttagttaccggcgcatcgcaaggcttgggcgaacaggtcgccaaagcctacgccgccgaaggggcgaccgtaattctggtggcacgccatcagaaaaaactggaaaaagcctatgacgcgattgtcgaagccggacaccccgaacccttcgccatccgtttcgacctgatgagtgcggaagaaaaagaattcgaacggtttgccgccaccattgccgaagccacgcaaggcaaactggacggcatcgtccactgcgccggctatttttacgccctctcgccgctggatttccaaaccgtcgccgaatgggtcaaccaataccgcatcaacaccgtcgccccgatggggctgacccgcgccctgttcccgctgctgaagcagtcgcccgacgcgtccgtcatcttcgtcggcgaaagccacggcgaaacacccaaagcctactggggcggcttcggcgcgtccaaagccgcgttgaactacctgtgcaaagtcgccgccgacgaatgggaacgcttcggcaacctgcgcgccaacgtcctcgtccccggccccatcaattccccgcaacgcatcaaatcccatccgggcgaagccggaagcgaacgcaaaagctacggggacgtactgcccgcatttgtctggtgggcaagtgccgaaagcaaagggcggagcggcgaaatcgtttacctc

SEQ ID NO: 5136 - protein, 239 aa, Neisseria gonorrhoeae
MPTLTDKTILVTGASQGLGEQVAKAYAAEGATVILVARHQKKLEKAYDAIVEAGHPEPFAIRFDLMSAEEKEFERFAATIAEATQGKLDGIVHCAGYFYALSPLDFQTVAEWVNQYRINTVAPMGLTRALFPLLKQSPDASVIFVGESHGETPKAYWGGFGASKAALNYLCKVAADEWERFGNLRANVLVPGPINSPQRIKSHPGEAGSERKSYGDVLPAFVWWASAESKGRSGEIVYL

SEQ ID NO: 5137 - DNA, 762 bp, Neisseria gonorrhoeae
atgcgcgcggaaggtacggatatttttcaaaacggaagcgcggcgcgggcgggatgcctgccttttccggatttagaggtaaacgatttcgccgctccgccctttgctttcggcacttgcccaccagacaaatgcgggcagtacgtccccgtagcttttgcgttcgcttccggcttcgcccggatgggatttgatgcgttgcggggaattgatggggccggggacgaggacgttggcgcgcaggttgccgaagcgttcccattcgtcggcggcgactttgcacaggtagttcaacgcggctttggacgcgccgaagccgccccagtaggctttgggtgtttcgccgtggctttcgccgacgaagatgacggacgcgtcgggcgactgcttcagcagcgggaacagggcgcgggtcagccccatcggggcgacggtgttgatgcggtattggttgacccattcggcgacggtttggaaatccagcggcgagagggcgtaaaaatagccggcgcagtggacgatgccgtccagtttgccttgcgtggcttcggcaatggtggcggcaaaccgttcgaattctttttcttccgcactcatcaggtcgaaacggatggcgaagggttcggggtgtccggcttcgacaatcgcgtcataggctttttccagttttttctgatggcgtgccaccagaattacggtcgccccttcggcggcgtaggctttggcgacctgttcgcccaagccttgcgatgcgccggtaac

SEQ ID NO: 5138 - protein, 254 aa, Neisseria gonorrhoeae
MRAEGTDIFQNGSAARAGCLPFPDLEVNDFAAPPFAFGTCPPDKCGQYVPVAFAFASGFARMGFDALRGIDGAGDEDVGAQVAEAFPFVGGDFAQVVQRGFGRAEAAPVGFGCFAVAFADEDDGRVGRLLQQREQGAGQPHRGDGVDAVLVDPFGDGLEIQRREGVKIAGAVDDAVQFALRGFGNGGGKPFEFFFFRTHQVETDGEGFGVSGFDNRVIGFFQFFLMACHQNYGRPFGGVGFGDLFAQALRCAGN

SEQ ID NO: 5139 - DNA, 669 bp, Neisseria gonorrhoeae
atgaaaaccgtttccgccgccatcgcttttgccgccgctgccgtttcactgaccggctgtgcgaccgagtcctcacgcagcctcgaggttgcaaaagtcgcctcctgcaatacgcaatatcacggtgttcgcaccccgatttccgtcggaacattcgacaaccgctccagcttccaaaaaggcattttctccgacagtgaagaccgtctgggcagccaggcaaaaaccatcctggtaacacacctgcaacaaaccaaccgcttcaacgtactgaaccgcaccaaccttagcgcattgaaacaggaatccggcatttccggcaaagcgcagaacctgaaaggcgcagattatgtcgttaccggcgatgtaaccgaattcggacgcagagatgtcggcgatcatcagctcttcggcattttgggtcgcggcaaatcgcaaatcgcctatgcaaaagtggctctgaatatcgtcaacgtcaatacttccgaaatcgtctattccacacagggcgcgggcgaatacgcactttccaaccgcgaaatcatcggtttcggcggcacttccggctacgatgcgactttgaacggcaaagttttagacttggcaatccgcgaagccgtcgacaacttggttcaggctgtcgacaacggcgcatggcaatccaaccgt

SEQ ID NO: 5140 - protein, 223 aa, Neisseria gonorrhoeae
MKTVSAAIAFAAAAVSLTGCATESSRSLEVAKVASCNTQYHGVRTPISVGTFDNRSSFQKGIFSDSEDRLGSQAKTILVTHLQQTNRFNVLNRTNLSALKQESGISGKAQNLKGADYVVTGDVTEFGRRDVGDHQLFGILGRGKSQIAYAKVALNIVNVNTSEIVYSTQGAGEYALSNREIIGFGGTSGYDATLNGKVLDLAIREAVDNLVQAVDNGAWQSNR

SEQ ID NO: 5141 - DNA, 186 bp, Neisseria gonorrhoeae
ttgcggaagccgccaacaaaaaaaatgaatgccgccccgggtgcgcacgcccatttgggactgctgctttcccgttcgggagacaaagagggcgcgttccgccaatttgaagaagagaaaaggctgtttcccgaatcgggcgtatttatggacttcctgatgaaaaccggtaaaggaggcaagcga

SEQ ID NO: 5142 - protein, 62 aa, Neisseria gonorrhoeae
LRKPPTKKMNAAPGAHAHLGLLLSRSGDKEGAFRQFEEEKRLFPESGVFMDFLMKTGKGGKR

SEQ ID NO: 5143 - DNA, 126 bp, Neisseria gonorrhoeae
atgagaaattttcctttgtcaagtgttaaagttataatgattatatactatatcacactacatcgcaatgaaaaatcgggaaaaacaaaaaacccctccgccgtcattcccgcgaaagcgggaatc

SEQ ID NO: 5144 - protein, 42 aa, Neisseria gonorrhoeae
MRNFPLSSVKVIMIIYYITLHRNEKSGKTKNPSAVIPAKAGI

SEQ ID NO: 5145 - DNA, 990 bp, Neisseria gonorrhoeae
cattttcgtcccgttttccaacatcaccgcaaactgcgccaaatccggcggcggctccgccttcaacaccagcggctcacccgtgagcggatggttcaggtgcagctcggacgcgtgcaaaaacatgcgcttcaaacccaatttctgcaaacgccggttcgcctgataatcgccgtagcgttcgtcgcccgcaatcggacagccttgagattgcagatgcacgcggatttggtgcgtacggcccgttttcagcgttgcccgcaccaaagtcaggtgcgacagcccgacaccgtgcaaaatgccgtctgagaaacggcttaacacacggaacaccgtatgcgccgactgcccgtcctcgctgacgcgtaccatcttttcgccttgtgcgccggtatatttgaacaggggcagtttgacatggaaattgtcgtccggcagtttgcccacccccagcgcaaggtagatttttttggggtggtcgttacggatagcttcgtgcagtttgacgagcgcgctgcgtttcttcgccaccatcaacaagccgctcgtatccttgtccaaacggtggaccaactccaaatacttcgcctccggacgggcgcggcgcaactgttcgataacgccgaaactcacgccgctgccaccgtgtaccgccacaccggaaggcttattgaccaccagtagcgcgtcgtcctcatacaccacctcaaacgcacgcgccggtacggcggcacgcctttcagacggcatttccttctccgccacgcgcacaggcggaatccgcaccgtatctccctccgcaatacggctgtcgggtttgcagcgtttcttgttcaaccgcacctcgccggcgcggataatgcggtggatatagcccttgggcacgcccttgaggatttttatcagatagttatcaaggcgttgacccgcctcatgttcggcaacccctatcaggctgaccgaacctttgcttatttcgtgcgttttcat

SEQ ID NO: 5146 - protein, 102 aa, Neisseria gonorrhoeae
HFRPVFQHHRKLRQIRRRLRLQHQRLTRERMVQVQLGRVQKHALQTQFLQTPVRLIIAVAFVARNRTALRLQMHADLVRTARFQRCPHQSQVRQPDTVQNAV

SEQ ID NO: 5147 - DNA, 1515 bp, Neisseria gonorrhoeae
ttggagatgttcaaaatgagtcgtgaaatgttacagctggcagaagcactggcaagcgaaaaaaacgttgatgcggaagtcgtcttccaagcactggaattcgcactctctaccgccgccaagaaaaaggcagaccgcgaacacatggacgtgcgcgtccaaatcaaccgcgataccggcgaataccaaaccttccgccgctggctgattgtggccgatgaagactatacctatcccgatgtcgaaaaaaccatcgaggaaatccaagaggaaatccccgatacgaccatccaaatcggcgaatactacgaagagcagctgcccaacgaaggcttcggccgccaagcggcgcaaactgccaaacaaatcatcctgcaacgcatccgcgatgccgagcgcgagcagaatctgaacgagttcctcgccgtcaaagaagacatcgtgtccggcacggtcaaacgcgtcgaacgccacgggatcatcgtcgaagtcgttgccggcaaactggacgcgctgattccgcgcgaccaaatgattccgcgcgaaaacttccgcagcggcgaccgcatccgcgccctcttcctgcgcgtcgaagaaatcggcaacaccggccgcaaacaaatcatcctgagccgtacttccggcgatttcctcgtcaaactgtacgccaatgaagtacctgaaattgcagacggcatgcttgaaatccgcgctgtcgcccgcgacccgggccaacgtgccaaagtcgccgtcaaagccaacgaccagcgcatcgatccgcaaggcacctgtatcggcgttcgcggttcgcgtgtcaatgccgtcagcaatgaattgtccggcgagcgcatcgacgttgtcctttggtcgcccgagcctgcccaattcgtcatgagcgcgctctcacccgccgaagtcagccgcatcgtcatcgacgaagacaaacacgccgtcgatgtcatcgttgccgaggaccggctcgcgctcgccatcgggcgcggcggtcaaaacgtgcgccttgcttccgacctgaccggctggcagctcaacatcatgacttccgccgaagcagacgaacgcaatgcggcagaagatgccgccatccgccgcctgtttatgaatcacttgaatgtagatgaagaaaccgccgacgtactggttcaagaaggttttgcaaccttggaagaagtcgcctatgttcctgccgccgaactgcttgccattgaaggatttgacgaagaaatcgtcgatatgctccgcaaccgtgcccgcgatgccatcctgaccatggcgattgctgccgaagaaaaactgggcgaagtgtccgacgatatgcgtaacctcgaaggcgtagatgccgatatgctcctcagccttgccgaagcaggcattaccacccgcgacgacttggcagagcttgccgtggacgaactgattgaaatcaccggtgtaaacgaagaaactgcaaaagccgtcatcctgaccgcacgcgaacactggtttaccgaagacaaa

SEQ ID NO: 5148 - protein, 505 aa, Neisseria gonorrhoeae
LEMFKMSREMLQLAEALASEKNVDAEVVFQALEFALSTAAKKKADREHMDVRVQINRDTGEYQTFRRWLIVADEDYTYPDVEKTIEEIQEEIPDTTIQIGEYYEEQLPNEGFGRQAAQTAKQIILQRIRDAEREQNLNEFLAVKEDIVSGTVKRVERHGIIVEVVAGKLDALIPRDQMIPRENFRSGDRIRALFLRVEEIGNTGRKQIILSRTSGDFLVKLYANEVPEIADGMLEIRAVARDPGQRAKVAVKANDQRIDPQGTCIGVRGSRVNAVSNELSGERIDVVLWSPEPAQFVMSALSPAEVSRIVIDEDKHAVDVIVAEDRLALAIGRGGQNVRLASDLTGWQLNIMTSAEADERNAAEDAAIRRLFMNHLNVDEETADVLVQEGFATLEEVAYVPAAELLAIEGFDEEIVDMLRNRARDAILTMAIAAEEKLGEVSDDMRNLEGVDADMLLSLAEAGITTRDDLAELAVDELIEITGVNEETAKAVILTAREHWFTEDK

SEQ ID NO: 5149 - DNA, 423 bp, Neisseria gonorrhoeae
atgccccttctgcctgccgaaccctttgacctcgctgacggtcatgcccgtaatgccgatttccgtcaacgcctcgcgcacgtcgtcgagcttgaacggtttgacaatcgcctcgatttttttcataaaatttcctttgaacaaacaatacaaacacatccgaaaaacgggaaccccccgtcagattgtcaacattttaaaccaaaatacccaagcaatacagcccccgttgcgcatataatgacagcttttccaaccgcatttgagagccgaatccatgtctgttgttttgcccttgcgcggcgttaccgccctttccgatttccgtgtcgaaaaactcttgcaaaaagccgccgcactcggcctgcccgaagtcaaattaagcagcgaattttggtatttcgccggcagcgagaaagcact

SEQ ID NO: 5150 - protein, 141 aa, Neisseria gonorrhoeae
MPLLPAEPFDLADGHARNADFRQRLAHVVELERFDNRLDFFHKISFEQTIQTHPKNGNPPSDCQHFKPKYPSNTAPVAHIMTAFPTAFESRIHVCCFALARRYRPFRFPCRKTLAKSRRTRPARSQIKQRILVFRRQREST

SEQ ID NO: 5151 - DNA, 294 bp, Neisseria gonorrhoeae
tttgaacaccgctttaaacggcttgatcagcacttcgctgtacacgccggcatgaacatagggatcgtcttcagcccaagcctgcgccgcatccaaagactcgaactgtgccacaatcaagctgcccgaaacacgttcgggattgtccggcagcaggtttgggcctgccgtcagcagacggccttccgatttcagcgtttccagccgtttaaagtgttcgggacgtgccgccatacgcgcttcatgcacatcctccccgtctgttgccagcaacataaaatattccacagtcaa

SEQ ID NO: 5152 - protein, 98 aa, Neisseria gonorrhoeae
FEHRFKRLDQHFAVHAGMNIGIVFSPSLRRIQRLELCHNQAARNTFGIVRQQVWACRQQTAFRFQRFQPFKVFGTCRHTRFMHILPVCCQQHKIFHSQ

SEQ ID NO: 5153 - DNA, 294 bp, Neisseria gonorrhoeae
ttggcggaacgcgccctctttgtctcccgaacgggaaagcagcagtcccaaatgggcgtgcgcacccggggcggcattcattttttttgttggcggcttccgcaaagtatttttccatcttttcggtctgcttgcccaacgaagtgtcgtcgtttttcaaaccttcatagacggtatcgggataaccgccgtaataatacaggtttttatgcccgccgccggcaggcggtcagagccaagaccgccgcacacagcgacaaacggcccaaggttttcggattcatcatttctcct

SEQ ID NO: 5154 - protein, 98 aa, Neisseria gonorrhoeae
LAERALFVSRTGKQQSQMGVRTRGGIHFFCWRLPQSIFPSFRSACPTKCRRFSNLHRRYRDNRRNNTGFYARRRQAVRAKTAAHSDKRPKVFGFIISP

SEQ ID NO: 5155 - DNA, 645 bp, Neisseria gonorrhoeae
atgaaacctttgattttagggcttgccgccgtgttggctctgtctgcctgccaagttcgaaaagctcccgacctcgactacacgtcattcaaagaaagcaaaccggcttcaattttggtggttccgccgctgaacgagtcgcctgatgtcaacggcacttgggggatgctggcttcgaccgccgcgccgatttccgaagccggctattacgtctttcccgccgcagtcgtggaggaaaccttcaaagaaaacggcttgaccaatgccgccgatattcacgccgtccggccggaaaaactgcatcaaattttcggcaatgatgcggttttgtacattacggttaccgaatacggcacttcatatcaaattttagacagcgtgacgaccgtatccgccaaagcacggctggtcgattcccgcaacgggaaagagttgtggtcgggttcggccagcatccgcgaaggcagcaacaacagcaacagcggcctgttgggggctttggtcggcgcagtggtcaatcagattgccaacagcctgaccgaccgcggttatcaggtttccaaaaccgccgcatacaacctactgtcgccctattcccgcaacggtatcttgaaaggtccgagattcgtcgaagagcagcccaaa

SEQ ID NO: 5156 - protein, 215 aa, Neisseria gonorrhoeae
MKPLILGLAAVLALSACQVRKAPDLDYTSFKESKPASILVVPPLNESPDVNGTWGMLASTAAPISEAGYYVFPAAVVEETFKENGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSRNGILKGPRFVEEQPK

SEQ ID NO: 5157 - DNA, 141 bp, Neisseria gonorrhoeae
atgcgaatcttgatacttgcaagccgcaccgcccaaaatcaggcgaccggtttcaatatccgaacaaggttcgggttctgtattttgcagaacccgaaccttttattcaaatttaaacttaattccggcgtggttgtatgg

SEQ ID NO: 5158 - protein, 47 aa, Neisseria gonorrhoeae
MRILILASRTAQNQATGFNIRTRFGFCILQNPNLLFKFKLNSGVVVW

SEQ ID NO: 5159 - DNA, 132 bp, Neisseria gonorrhoeae
ttgcaagccgcaccgcccaaaatcaggcgaccggtttcaatatccgaacaaggttcgggttctgtattttgcagaacccgaaccttttattcaaatttaaacttaattccggcgtggttgtatggtaaatta

SEQ ID NO: 5160 - protein, 44 aa, Neisseria gonorrhoeae
LQAAPPKIRRPVSISEQGSGSVFCRTRTFYSNLNLIPAWLYGKL

SEQ ID NO: 5161 - DNA, 96 bp, Neisseria gonorrhoeae
ttgttaatccactataacaagcaatatgccctgaccggcaaaacttccccaaacttcatcaaaaaatcaactgtacccgtctttttcagacggcat

SEQ ID NO: 5162 - protein, 32 aa, Neisseria gonorrhoeae
LLIHYNKQYALTGKTSPNFIKKSTVPVFFRRH

SEQ ID NO: 5163 - DNA, 105 bp, Neisseria gonorrhoeae
atgggaaatctcttacggtatcaatgccgtctgaaaaagacgggtacagttgattttttgatgaagtttggggaagttttgccggtcagggcatattgcttgtta

SEQ ID NO: 5164 - protein, 35 aa, Neisseria gonorrhoeae
MGNLLRYQCRLKKTGTVDFLMKFGEVLPVRAYCLL

SEQ ID NO: 5165 - DNA, 369 bp, Neisseria gonorrhoeae
atgcaaaaccggcaaaccgagctttattccacgccgtcttggctgttgcagaccttattgatgattaccgccgcctcggcggtgattctgtttttcgcgcgcaacacgcgcttggggcgggagtttgcctatatcctgcgcctttgcctgacaccgaaaagcacggtcaaagtattgctgctgattacggcaatggttacgctgctgttaaccgaagtgcggttgaatgtgttgagtaccttcatgtccaaaggactttacgattcgatgcaggatttgaatgcttcggcattttggatgtttgcagcgatgaacgccggcgtggtactgatacgggcgtttaacaacgtcgttaacgactttctcgat

SEQ ID NO: 5166 - protein, 123 aa, Neisseria gonorrhoeae
MQNRQTELYSTPSWLLQTLLMITAASAVILFFARNTRLGREFAYILRLCLTPKSTVKVLLLITAMVTLLLTEVRLNVLSTFMSKGLYDSMQDLNASAFWMFAAMNAGVVLIRAFNNVVNDFLD

SEQ ID NO: 5167 - DNA, 816 bp, Neisseria gonorrhoeae
atgaaaaaaaaccatttgaacacaaccggtttcgacctctggcacaccatccgcgaagaaaccgcggccgctgccgccgccgaaccgatgctggcaagttttttgcaccaaaccgtgttgcgccacgagtccctcggctccgtccttgcctaccacctttccagcaaactcggcagcccgattatggacgtgcgcgcgctgtttgaaatttaccagcaggcattgggcagcgacacccaaatcagcaaatgtgtcgaagcagacttaaaagccatctacgaacgcgatcccgcctgcgacgaatattcgctgccgcttttatatttcaaaggcttccacgcgattcaggcacaccgcatcaaccaccggctgtatctcgacggacgcaaaacgctggcgtatttcctacaaaaccgtatgtccgaagtattcggcgtggacatccatcccgccgcccgtttaggatacgggctgatgctcgaccacgccaccggctttgttgccggagaaaccgccgtgttgggcaacaatatttcgattttgcacggcgtaacgctcggcggttcgggcaaagaaggcggcgaccgccaccccaaaatcggcgacggcgtgatgatcggcgcaaacgcctcgatattgggcaatatccgcatcggcagcaatgccaaaatcggcgcgggcagcgtcgtggtttcagacgtgccgccgtccatcacggttgtcggcgtacccgccaaacccgtggcgcgatcgctcaaaaccccgtcggcggatatggatcaaaatatccagtttgccgaaatcgactttatgatt

SEQ ID NO: 5168 - protein, 272 aa, Neisseria gonorrhoeae
MKKNHLNTTGFDLWHTIREETAAAAAAEPMLASFLHQTVLRHESLGSVLAYHLSSKLGSPIMDVRALFEIYQQALGSDTQISKCVEADLKAIYERDPACDEYSLPLLYFKGFHAIQAHRINHRLYLDGRKTLAYFLQNRMSEVFGVDIHPAARLGYGLMLDHATGFVAGETAVLGNNISILHGVTLGGSGKEGGDRHPKIGDGVMIGANASILGNIRIGSNAKIGAGSVVVSDVPPSITVVGVPAKPVARSLKTPSADMDQNIQFAEIDFMI

SEQ ID NO: 5169 - DNA, 90 bp, Neisseria gonorrhoeae
ttgaaccaagaaaacatcatcgcccacacccttccgaaaagcggtattgtacaggcaaaccgcttgggaaacgtgataaaatcaggcgga

SEQ ID NO: 5170 - protein, 30 aa, Neisseria gonorrhoeae
LNQENIIAHTLPKSGIVQANRLGNVIKSGG

SEQ ID NO: 5171 - DNA, 216 bp, Neisseria gonorrhoeae
ttggcgattaaatggtcggaacggctcaatgaagttttgacttcgcgctggcttgccgacaaaaactactaccgcctgcaaatgcgccgccacgcgccggacaacatcgaccagcgtatccaacaggatgcgcaggaattcatcgcttcgaccatcgaatttgtgcgcggcatggtcaattcggtcgttacttctctggaatttgccgttgttttg

SEQ ID NO: 5172 - protein, 72 aa, Neisseria gonorrhoeae
LAIKWSERLNEVLTSRWLADKNYYRLQMRRHAPDNIDQRIQQDAQEFIASTIEFVRGMVNSVVTSLEFAVVL

SEQ ID NO: 5173 - DNA, 429 bp, Neisseria gonorrhoeae
gtgcggaatgtcgaagccgaacacggtcaggatgcctgccaagccctacaaaacaacggcaaattccagagaagtaacgaccgaattgaccatgccgcgcacaaattcgatggtcgaagcgatgaattcctgcgcatcctgttggatacgctggtcgatgttgtccggcgcgtggcggcgcatttgcaggcggtagtagtttttgtcggcaagccagcgcgaagtcaaaacttcattgagccgttccgaccatttaatcgccaagccttaatcgagaaagtcgttaacgacgttgttaaacgcccgtatcagtaccacgccggcgttcatcgctgcaaacatccaaaatgccgaagcattcaaatcctgcatcgaatcgtaaagtcctttggacatgaaggtactcaacacattcaaccgcacttcggt

SEQ ID NO: 5174 - protein, 143 aa, Neisseria gonorrhoeae
VRNVEAEHGQDACQALQNNGKFQRSNDRIDHAAHKFDGRSDEFLRILLDTLVDVVRRVAAHLQAVVVFVGKPARSQNFIEPFRPFNRQALIEKVVNDVVKRPYQYHAGVHRCKHPKCRSIQILHRIVKSFGHEGTQHIQPHFG

SEQ ID NO: 5175 - DNA, 684 bp, Neisseria gonorrhoeae
ttggcaggcatcctgaccgtgttcggcttcgacattccgcacggcattgtttggtttgtctttattttcatgattttggcgatctttatcgccatgtggataggcaaccctttgattcgttacaattatgaaaacaaaaaactcaacggcgactaccgttattccctcatcctcgtacgcgaccacgccgaaagcgtggcgttttacagcggcgaacaacacgaacacggccggctttccgaccgctttaaagccattatccgcaaccgttggcgcatcgcgcggcaaagcgtctgcttaagcggctttaacgatatgttcaccaacggcatcaaactcttcctgattattttgcaagctccgcgcctgtttgccggacaaatcaaaatcggcgacatccagcagaccgtccaagccttcgcgcgactgcaaaacgcgctgtctttcttccgaatgttctacaacaaattcaccgcctgccacgcccgactggagcgtctgtacgtctttttgctgagtaccgaagaacaacacggcgcgcagcaacccgagattagcgaagtttcagacggcattgcactggaaaacgtcgccctgttccgccacaacggcgaagttttattggacggcatcaacatcaaactcaaaagcggcgattccctgctgatacgcggcccgagcggt

SEQ ID NO: 5176 - protein, 228 aa, Neisseria gonorrhoeae
LAGILTVFGFDIPHGIVWFVFIFMILAIFIAMWIGNPLIRYNYENKKLNGDYRYSLILVRDHAESVAFYSGEQHEHGRLSDRFKAIIRNRWRIARQSVCLSGFNDMFTNGIKLFLIILQAPRLFAGQIKIGDIQQTVQAFARLQNALSFFRMFYNKFTACHARLERLYVFLLSTEEQHGAQQPEISEVSDGIALENVALFRHNGEVLLDGINIKLKSGDSLLIRGPSG

SEQ ID NO: 5177 - DNA, 177 bp, Neisseria gonorrhoeae
atgaacacctgccgcttgggttatctgattgacaaattggataaaacagacggctggcagcacaaactctcccccggcgaactgcaacgcgtcgccttcgtccgcgccctgctctccaagcccaaaatcgtcctgctcgacgaagccgccgccgccttggacgaaccggccgaagcc

SEQ ID NO: 5178 - protein, 59 aa, Neisseria gonorrhoeae
MNTCRLGYLIDKLDKTDGWQHKLSPGELQRVAFVRALLSKPKIVLLDEAAAALDEPAEA

SEQ ID NO: 5179 - DNA, 135 bp, Neisseria gonorrhoeae
atgccgtctgaaaacggcttcagacggcatcgttcagccgcaggcagcgttgccgacatcgaggtgcatattgcggaacgcgttgagcgtacttcggtgtccgatactgatgatgctgtcgggcagtttttgctt

SEQ ID NO: 5180 - protein, 45 aa, Neisseria gonorrhoeae
MPSENGFRRHRSAAGSVADIEVHIAERVERTSVSDTDDAVGQFLL

SEQ ID NO: 5181 - DNA, 165 bp, Neisseria gonorrhoeae
gtgtctttccaatttgaacgatgccgtctgaaaacggcttcagacggcatcgttcagccgcaggcagcgttgccgacatcgaggtgcatattgcggaacgcgttgagcgtacttcggtgtccgatactgatgatgctgtcgggcagtttttgctttaaggcgcgg

SEQ ID NO: 5182 - protein, 55 aa, Neisseria gonorrhoeae
VSFQFERCRLKTASDGIVQPQAALPTSRCILRNALSVLRCPILMMLSGSFCFKAR

SEQ ID NO: 5183 - DNA, 126 bp, Neisseria gonorrhoeae
tattaaaaacgcactccgcaaagcattttccctgcgcctgttcccagccggcaggcgcagaacgtagtcaagtttgaattgattttgccgtttcggcgcggaagtaagacggcagcggagccccaa

SEQ ID NO: 5184 - protein, 40 aa, Neisseria gonorrhoeae
KRTPQSIFPAPVPSRQAQNVVKFELILPFRRGSKTAAEPQ

SEQ ID NO: 5185 - DNA, 384 bp, Neisseria gonorrhoeae
gtgaaacagcttgaaccaagaaaacatcatcgcccacacccttccgaaaagcggtattgtacaggcaaaccgcttgggaaacgtgataaaatcaggcggataaacaaatcgaataaatccttaccgcaaaacggaggcaaaatgctcaaatccatcgaactcaattcacacatccgcaaccgccttgcagcatatctgaaaggcaggggtttggattttcagacggcaatgcaggaagaagaaggcaacaaagaaatcgccgccatcgtccacagcggtctgcccactctggtccgcaaactgtattccgaacaaaaaatgcagaagtttttttgggaaaagcgggatttgattgccgactacatcagccgccggatgcaggga

SEQ ID NO: 5186 - protein, 128 aa, Neisseria gonorrhoeae
VKQLEPRKHHRPHPSEKRYCTGKPLGKRDKIRRINKSNKSLPQNGGKMLKSIELNSHIRNRLAAYLKGRGLDFQTAMQEEEGNKEIAAIVHSGLPTLVRKLYSEQKMQKFFWEKRDLIADYISRRMQG

SEQ ID NO: 5187 - DNA, 666 bp, Neisseria gonorrhoeae
gtgaaccagcttattttcgactttgccgcacacgactatccgagtttcgacaaattcctcggcacggaaaatgccgaactggtctatgtgttacagcataaacacgacccgtttatctacgtctggggcgaagaaggcgcgggcaaaagccatctgttgcaggcgtgggtcgcacaggcgctcgaagccggcaaaaacgccgcctatatcgatgccgcctccatgccgctgaccgatgccgcgtttgaggcagaatacctcgccgtcgatcaagtcgaaaaactgggcaacgaagaacaagccctgcttttttccatcttcaaccgcttccgcaacagcggcaaaggctttttgctgctcggttcggaatacacgccccagcagctcgtcatccgcgaagatttgcggacgcgtatggcatactgcctcgtttacgaagtcaagccactaaccgaccaagaaaaaatcgacgcgctcgccaatatggcggcggcacgccaagtaaccgtcgattccgaaattttcgaatacctgctcaaacactggcggcgcgatatggacagcctgatgatgatgctcgacacgctggacaactacgccgtaaccatgggcaaacgcatcaccctgccgctgcttcgccagcttttgaaacaacaggaaacccaa

SEQ ID NO: 5188 - protein, 222 aa, Neisseria gonorrhoeae
VNQLIFDFAAHDYPSFDKFLGTENAELVYVLQHKHDPFIYVWGEEGAGKSHLLQAWVAQALEAGKNAAYIDAASMPLTDAAFEAEYLAVDQVEKLGNEEQALLFSIFNRFRNSGKGFLLLGSEYTPQQLVIREDLRTRMAYCLVYEVKPLTDQEKIDALANMAAARQVTVDSEIFEYLLKHWRRDMDSLMMMLDTLDNYAVTMGKRITLPLLRQLLKQQETQ

SEQ ID NO: 5189 - DNA, 666 bp, Neisseria gonorrhoeae
atgaaaaacctcgccatcttcgacctcgacaacaccctcatcaacaccgattccgaccacgcctggccgcaatacctcatcaaaaaagggttggttgacgctgccgaaaccgaagcgcaaaacgaaaaattctaccgcgactaccaaaacggctgcctcgacatcgacgcattcctcaaactccacctcgccccgctcgcccgttacagcaaagaagagctggcggagtttcaccgcgaatttatggcggaatacatcatcccccacatctcgcctatgcagcgtatgctggtgcagagccaccaaatggcaggcgacgaaaccctcgtgatttcctcaaccaacgagttcatcatcacccccgtctgccgccttttcggcatcgccaacatgatcggcacacaactcgaaaccggtcccgacggccgctacaccggcaattacatcggcacgcccagcctcaaagaaggcaaaatcacccgtctgaaccaatggctcgccgaacgcggcgaaacgctcgaaagctacggcaaaacctatttttacagcgactccaaaaacgacctgccgctgctgcgcctcgtcagcgaacccgtcgccgtcaaccccgatgccgaactggaaaaagaagccaaagaaaaaggctggccggttttgaatttcaaa

SEQ ID NO: 5190 - protein, 222 aa, Neisseria gonorrhoeae
MKNLAIFDLDNTLINTDSDHAWPQYLIKKGLVDAAETEAQNEKFYRDYQNGCLDIDAFLKLHLAPLARYSKEELAEFHREFMAEYIIPHISPMQRMLVQSHQMAGDETLVISSTNEFIITPVCRLFGIANMIGTQLETGPDGRYTGNYIGTPSLKEGKITRLNQWLAERGETLESYGKTYFYSDSKNDLPLLRLVSEPVAVNPDAELEKEAKEKGWPVLNFK

SEQ ID NO: 5191 - DNA, 141 bp, Neisseria gonorrhoeae
atgccgtctgaagcccgattcggcgttcagacggcattgaggctgaaatcccaaaaacccaaagccacaggaattcatcgggaaaaacaacaatctttccaccgtcattcccacgaaagtgggaatctaggacgtaaaatc

SEQ ID NO: 5192 - protein, 47 aa, Neisseria gonorrhoeae
MPSEARFGVQTALRLKSQKPKATGIHREKQQSFHRHSHESGNLGRKI

SEQ ID NO: 5193 - DNA, 156 bp, Neisseria gonorrhoeae
gtgggaatgacgaaatttcaaagttatggcgttatcggaaaaacagaaaatcaaagccggagaatttatccaaaacaaccggatttcaaaaaaaccaaattcccggcgggaatgacggattttaggtttctgttgtggtttctgtttgctcgggaa

SEQ ID NO: 5194 - protein, 52 aa, Neisseria gonorrhoeae
VGMTKFQSYGVIGKTENQSRRIYPKQPDFKKTKFPAGMTDFRFLLWFLFARE

SEQ ID NO: 5195 - DNA, 285 bp, Neisseria gonorrhoeae
atgccggctttggcggaaaacctgtttgtccggtttctgtttttggggtttcgggcaatttctaagttgttattcccgagcaaacagaaaccacaacagaaacctaaaatccgtcattcccgccgggaatttggtttttttgaaatccggttgttttggataaattctccggctttgattttctgtttttccgataacgccataactttgaaatttcgtcattcccacgcaggcgggaatccagacctgtcggcacggaaacttatcgggaaaaaaaggtttctt

SEQ ID NO: 5196 - protein, 95 aa, Neisseria gonorrhoeae
MPALAENLFVRFLFLGFRAISKLLFPSKQKPQQKPKIRHSRREFGFFEIRLFWINSPALIFCFSDNAITLKFRHSHAGGNPDLSARKLIGKKRFL

SEQ ID NO: 5197 - DNA, 894 bp, Neisseria gonorrhoeae
atggagtttgaaaacattatttccgccgccgacaaggcgcgtatccttgccgaagcactgccttacatccgccggttttccggttcggtcgccgtcatcaagtatggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggcgaatttgtccaaggaatgcgcgttaccgacaaagagacgatggatattgtcgaaatggtattgggcgggcacgtcaacaaggaaatcgtgtcgatgattaacacatatggagggcacgcggtcggcgtgagcgggcgcgacgaccatttcattaaggcgaagaaacttttggtcgatacgcccgaacagaatagcgtggacatcggacaggtcggtacggtggaaagcatcgataccggtttggttaaagggctgatagaacgcggctgcattcccgtcgtcgcccccgtcggcgtaggtgaaaaaggcgaagcgttcaacatcaacgccgatttggtggcaggcaaattggcggaagaattgaacgccgaaaaactcttgatgatgacgaatatcgccggtgtgatggacaaaacgggcaatctgctgaccaaactcacgccgaaacggattgatgggctgattgccgacggcacgctgtatggcggtatgctgccgaaaatcgcttctgcggtcgaagccgccgtcaacggtgtgaaagccacgcacatcatcgacggcaggttgcccaacgcgcttttgctggaaatctttaccgatgccggtatcgggtcgatgattttaggcagaggggaagatgcc

SEQ ID NO: 5198 - protein, 298 aa, Neisseria gonorrhoeae
MEFENIISAADKARILAEALPYIRRFSGSVAVIKYGGNAMTEPALKEGFARDVVLLKLVGIHPVIVHGGGPQINAMLEKVGKKGEFVQGMRVTDKETMDIVEMVLGGHVNKEIVSMINTYGGHAVGVSGRDDHFIKAKKLLVDTPEQNSVDIGQVGTVESIDTGLVKGLIERGCIPVVAPVGVGEKGEAFNINADLVAGKLAEELNAEKLLMMTNIAGVMDKTGNLLTKLTPKRIDGLIADGTLYGGMLPKIASAVEAAVNGVKATHIIDGRLPNALLLEIFTDAGIGSMILGRGEDA

SEQ ID NO: 5199 - DNA, 426 bp, Neisseria gonorrhoeae; identical to SEQ ID NO: 925

SEQ ID NO: 5200 - protein, 142 aa, Neisseria gonorrhoeae; identical to SEQ ID NO: 926

SEQ ID NO: 5201 - DNA, 303 bp, Neisseria gonorrhoeae
aaaacgcactccgcaaagcattttccctgcgcctgttcccagccggcaggcgcagaacgtagtcaagtttgaattgattttgccgtttcggcgcggaagtaagacggcagcggagccccaagccccgaacgcaaaccgcccgaaaacacaggcatcacgataacaagaagaagccggcgcccatttttccgaccgcagcgttcggaacgcggcaggcagaccgccgcatcgatctttatagccttctttatccgacccttccgcacacggttccccggaacgtgcatccctgcggattttcaa

SEQ ID NO: 5202 - protein, 23 aa, Neisseria gonorrhoeae
KTHSAKHFPCACSQPAGAERSQV

SEQ ID NO: 5203 - DNA, 159 bp, Neisseria gonorrhoeae
ttgtccgaatcattgcccgactccgcccgtttacaaggaaaccggttatttccggttgcgtgggaatcgggcgtatcgaataaaaggcattttgtccgactgataagtgccggcatcggcggcatattaaggcgcaggcttgaagcgggcaatgccgtc

SEQ ID NO: 5204 - protein, 53 aa, Neisseria gonorrhoeae
LSESLPDSARLQGNRLFPVAWESGVSNKRHFVRLISAGIGGILRRRLEAGNAV

SEQ ID NO: 5205 - DNA, 105 bp, Neisseria gonorrhoeae
ttgttgacaatttcggcttatgttaacgccaaacgccgtctgaaacaatcttcagacggcgtttggcacaccttcgggcaggttgaagccttgcgatacgggcgg

SEQ ID NO: 5206 - protein, 35 aa, Neisseria gonorrhoeae
LLTISAYVNAKRRLKQSSDGVWHTFGQVEALRYGR

SEQ ID NO: 5207 - DNA, 1203 bp, Neisseria gonorrhoeae
ttgaagccttgcgatacgggcggtaaaatcgcggtttatccggttcgagaaaccggcgacagcaaggactttcccatgattaaaatcagcacccgcttcgatgccggctcggtcgtcgtcaaagacctgaccgacccttccaacatccgcctcgccctgcgtcccgacaacgcctccgatttcgcacaatggttctacttccggctgcaaggcgcggcctatcaaaactgcatcatgcattttgaaaacgcggcagaagccgcctacccgaaaggctgggaaggctatcaggcgtgtgcctcatacgaccgccgcaactggttccgcgtaccgacttcctacgaaaacggcgtactgaccgtcaatcatacgccgctgtccaacagcgtgtattacgcctatttcgaaccctattccgaagagcagcacctcaacctcctcggcgacgcgcaaggcagcggcctgtgccgcatcgacgacttgggcagcaccgtgcaaggccgcgacatcaatctgctgaccataggcaaccaagtcgaaagcgacatgaaaatctggattaccgcccgccagcacccgggagaaaccatggcggaatggtttgtcgaagggctgctcggcaggctgctcgattcgcaagacccgacagcacgcaccctgctcgaccgcgccacgttctacatcgtccccaatatgaatcccgacggttcggcactgggcaaccttcgtaccaacgccgccggtgcgaacctcaaccgcgaatgggaaaacccgactttggaaaaaagccccgaagtgttcttcgtgcgcggaaaaatgctggaaaccggcgtggatttgtttttggacatccacggcgatgaaggtctgccctttgtctttgttgcaggaacggaaggtgtgccgaactacaatccgcgcatttccgcgttggaagcgcagttcaaaaccgcccttttgaacgccagccccgatttccaagacgaatacggttacgaaaaagacgcgccgggcaaagcgaatatgaccttggcgaccaactgggtcggcaaccgtttcaactgccttgcctacacgctggaaatgccgttcaaagacaacgccaacctgcccgacgacgacttcggctggaacggccagcgttctttgcggcttggggaagcggtgctttccgccattttgaacgtcgccggcgatttgcgc

SEQ ID NO: 5208 - protein, 401 aa, Neisseria gonorrhoeae
LKPCDTGGKIAVYPVRETGDSKDFPMIKISTRFDAGSVVVKDLTDPSNIRLALRPDNASDFAQWFYFRLQGAAYQNCIMHFENAAEAAYPKGWEGYQACASYDRRNWFRVPTSYENGVLTVNHTPLSNSVYYAYFEPYSEEQHLNLLGDAQGSGLCRIDDLGSTVQGRDINLLTIGNQVESDMKIWITARQHPGETMAEWFVEGLLGRLLDSQDPTARTLLDRATFYIVPNMNPDGSALGNLRTNAAGANLNREWENPTLEKSPEVFFVRGKMLETGVDLFLDIHGDEGLPFVFVAGTEGVPNYNPRISALEAQFKTALLNASPDFQDEYGYEKDAPGKANMTLATNWVGNRFNCLAYTLEMPFKDNANLPDDDFGWNGQRSLRLGEAVLSAILNVAGDLR

SEQ ID NO: 5209 - DNA, 849 bp, Neisseria gonorrhoeae
atgattatccatcaccaattcgatcccgtcctcatcagtatcggcccgcttgccgtccgctggtatgccttaagctacatcctcggatttattctttttacctttctcggcagaaggcgcatcgcgcaaggcttgtccgtttttaccaaagaatcgctcgacgacttcctgacatggggcattttgggcgtgattttgggcggacgcttgggctatgtcctgttttacaaattctccgactacctcgcccatccgcttgatattttcaaggtatgggaaggcggaatgtcgttccacggcggctttttgggtgtagttattgccatatggttgttcagccgcaagcacggcatcggcttcctcaaactgatggacacggtcgcgccgctcgttccgctgggtctcgcttcgggacgtatcggcaactttatcaacggcgaactttggggacgcattaccgacattaacgcattttgggcaatgggcttcccgcaagcgcattacgaagatgccgaagccgccgcgcacaatccgctttgggcagaatggctgcaacaatacggtatgctgccgcgtcatccctcgcagctttatcagtttgcccttgaaggcatctgcctgttcgccgtcgtttggctgttttccaaaaaaccgcgcccgaccgggcagactgccgcgctttttctcggcggctacggcgtgttccgctttattgccgaatttgcgcgccaacccgacgactatctcgggctgctgaccttggggctgtcgatggggcaatggttgagcgtcccgatgattgttttgggtatcgtcggctttgtccggttcggcatgaaaaaacagcac

SEQ ID NO: 5210 - protein, 283 aa, Neisseria gonorrhoeae
MIIHHQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFSRKHGIGFLKLMDTVAPLVPLGLASGRIGNFINGELWGRITDINAFWAMGFPQAHYEDAEAAAHNPLWAEWLQQYGMLPRHPSQLYQFALEGICLFAVVWLFSKKPRPTGQTAALFLGGYGVFRFIAEFARQPDDYLGLLTLGLSMGQWLSVPMIVLGIVGFVRFGMKKQH

SEQ ID NO: 5211 - DNA, 669 bp, Neisseria gonorrhoeae
atggaaatccggtttcagacagcatttttacgtttggttcagatgaaaacaaacgcttcaattcttaccgcaacacgccttgtatttcctgccgctgccgcacggacagggatcgttcctgccggttttttccccttccctgcggacggtttgcggtttgttgatgaccgcctgccagtagcggtagatgtctgccagcgcgtaaggcagttcggacgcaagttccgccagctcgccttcggtgaattgcaggcggatagcgccgttttcctcttcgtcgtaaatgccgcccaatgccatcacggggtaaaacagctcttcaaacgcttcatcatcggcggcttcaaaccaatcggtcggcacaatgtccaaaccgtaaagataggcgttgcaccaagtgtaaaaatcgctgccgccctcgccgtcgtcgtagagccacaaatcgggcagctttttatccgacatcgcggcggttgtttccatcgccattgccaaaaccagccgttcgatttcggaacgttcggcggcggtaaattgcgattcgtcgcccaacacttcgggcagccagtcgagcggtgccaatttgtccggcccgctcaacagcgccgtcataaaaccttgaacctcgtcgcaacgcatcgtgttgccttgttcgcttttggcatccaa

SEQ ID NO: 5212 - protein, 223 aa, Neisseria gonorrhoeae
MEIRFQTAFLRLVQMKTNASILTATRLVFPAAAARTGIVPAGFFPFPADGLRFVDDRLPVAVDVCQRVRQFGRKFRQLAFGELQADSAVFLFVVNAAQCHHGVKQLFKRFIIGGFKPIGRHNVQTVKIGVAPSVKIAAALAVVVEPQIGQLFIRHRGGCFHRHCQNQPFDFGTFGGGKLRFVAQHFGQPVERCQFVRPAQQRRHKTLNLVATHRVALFAFGIQ

SEQ ID NO: 5213 - DNA, 675 bp, Neisseria gonorrhoeae
ttgaaaaggaaaatgatggattcccgaaaatttaccgaagcatccaaacggcggttgggcgaattattggatgccaaaagcgaacaaggcaacacgatgcgttgcgacgaggttcaaggttttatgacggcgctgttgagcgggccggacaaattggcaccgctcgactggctgcccgaagtgttgggcgacgaatcgcaatttaccgccgccgaacgttccgaaatcgaacggctggttttggcaatggcgatggaaacaaccgccgcgatgtcggataaaaagctgcccgatttgtggctctacgacgacggcgagggcggcagcgatttttacacttggtgcaacgcctatctttacggtttggacattgtgccgaccgattggtttgaagccgccgatgatgaagcgtttgaagagctgttttaccccgtgatggcattgggcggcatttacgacgaagaggaaaacggcgctatccgcctgcaattcaccgaaggcgagctggcggaacttgcgtccgaactgccttacgcgctggcagacatctaccgctactggcaggcggtcatcaacaaaccgcaaaccgtccgcagggaaggggaaaaaaccggcaggaacgatccctgtccgtgcggcagcggcaggaaatacaaggcgtgttgcggtaagaat

SEQ ID NO: 5214 - protein, 225 aa, Neisseria gonorrhoeae
LKRKMMDSRKFTEASKRRLGELLDAKSEQGNTMRCDEVQGFMTALLSGPDKLAPLDWLPEVLGDESQFTAAERSEIERLVLAMAMETTAAMSDKKLPDLWLYDDGEGGSDFYTWCNAYLYGLDIVPTDWFEAADDEAFEELFYPVMALGGIYDEEENGAIRLQFTEGELAELASELPYALADIYRYWQAVINKPQTVRREGEKTGRNDPCPCGSGRKYKACCGKN

SEQ ID NO: 5215 - DNA, 489 bp, Neisseria gonorrhoeae; identical to SEQ ID NO: 939

SEQ ID NO: 5216 - protein, 163 aa, Neisseria gonorrhoeae; identical to SEQ ID NO: 940

SEQ ID NO: 5217 - DNA, 1791 bp, Neisseria gonorrhoeae
atgcaattagatatagaccgtctggtcgcctatttcggcggcgtgaacgcgcttgccgaagcgttgaaacggcacgatcctgaaaatgccgcgacgaccgccgccatctacaaatggcgcacacgcggctcgctgcctttggcgcaactgcaaaaattgaccgcgcttgccgaatcgcaaggaagaccgctggatttgaatgcttttttacaaaaaaacgaatctctggagagaacagaaatgacacaggccaaccgcgttattattttcgacaccaccctgcgcgacggcgaacaatcgcccggcgccgctatgaccaaagaggaaaaaatccgcgtcgcccgccagttggaaaaattgggcgcggacatcatcgaagcgggttttgccgccgccagcccgggcgatttcgaggcggtcaatgcgattgcgaaaaccattaccaaatcaacggtctgttcattgtcccgcgccatcgagcgggacatccgtcaggcgggtaaggccgttgcgcccgcgccgaaaaaacgcatccacaccttcatcgccaccagccccatccatatggagtacaagctgaagatgaagccgaagcaggtgattgaggcggcggtcaaagcggtaaaaatcgctcgtgaatacaccgacgatgtggaattttcctgcgaagacgcgttgcgttcgcaaatcgatttccttgccgaaatctgcggcgcggtgattgaagcgggcgcgaccaccatcaatattcccgataccgtcggctattccatcccgtacaaaaccgaagaatttttccgcgaactgattgccaaaacgcccaacggcggcaaagtcgtctggtcggcacactgccacaacgatttgggcttggcggttgccaattcgcttgccgcattaaaaggcggcgcgcgtcaggtggaatgtaccgttaacggtttgggcgaacgcgcggggaatgcttcggttgaagaaatcgtgatggcgttgaaggtgcgccacgacttgttcggcttggaaaccggcatcgataccacgcaaatcgtgccttcgtccaaactggtgtccaccattacgggctatcccgtgcagcccaataaagccattgtcggcgcgaatgccttttcgcacgaatcgggcatccatcaggacggggtgctgaaacaccgcgaaacttacgagattatgtctgccgaatcggtcggttggtcggcaaaccgattgagcttgggcaaattgtccggccgcaacgccttcaaaaccaagctggcggatttgggcatcgagttggaaagcgaagaggcactgaacgcggcatttgcacgcttcaaagaactcgccgacaaaaaacgcgaaatcttcgatgaagacctgcacgcgctggtgtcggacgaaatgggcaatatgaatgccgaaagctataaattcatttctcaaaaaatcagcaccgaaaccggcgaagagccgcgcgccgacatcgtgttcggcatcaaaggcgaagaaaaacgcgcttccgcaaccggctccggccctgttgatgcaattttcaaagcgattgagagcgtggcgcaaagcggcgcgactttgcagatttattccgtcaacgccgtcacgcaaggtacggaaagccaaggcgaaaccagcgtccgtttggcgcgcggcaaccgcgtcgtcaacggtcagggcgcggataccgacattttggcggcgaccgccaaagcttacctttccgctttgagcaagctggaatttagtgccgccaaaccgaaggcgcagggcagcggtacgatt

SEQ ID NO: 5218 - protein, 597 aa, Neisseria gonorrhoeae
MQLDIDRLVAYFGGVNALAEALKRHDPENAATTAAIYKWRTRGSLPLAQLQKLTALAESQGRPLDLNAFLQKNESLERTEMTQANRVIIFDTTLRDGEQSPGAAMTKEEKIRVARQLEKLGADIIEAGFAAASPGDFEAVNAIAKTITKSTVCSLSRAIERDIRQAGKAVAPAPKKRIHTFIATSPIHMEYKLKMKPKQVIEAAVKAVKIAREYTDDVEFSCEDALRSQIDFLAEICGAVIEAGATTINIPDTVGYSIPYKTEEFFRELIAKTPNGGKVVWSAHCHNDLGLAVANSLAALKGGARQVECTVNGLGERAGNASVEEIVMALKVRHDLFGLETGIDTTQIVPSSKLVSTITGYPVQPNKAIVGANAFSHESGIHQDGVLKHRETYEIMSAESVGWSANRLSLGKLSGRNAFKTKLADLGIELESEEALNAAFARFKELADKKREIFDEDLHALVSDEMGNMNAESYKFISQKISTETGEEPRADIVFGIKGEEKRASATGSGPVDAIFKAIESVAQSGATLQIYSVNAVTQGTESQGETSVRLARGNRVVNGQGADTDILAATAKAYLSALSKLEFSAAKPKAQGSGTI

SEQ ID NO: 5219 - DNA, 198 bp, Neisseria gonorrhoeae
ttgccgccttgtaccgccgaatttgccctgttctgtcgcaattgtcaacaatcacgccgcatctgcaataaaatagacaaaatgtataaaattaataaaatttatagcaacttattgagattttttcaaattaatattgccgttttgtccaaaatgcgtataatcctgtccatatttctgctgcgggctgatttattt

SEQ ID NO: 5220 - protein, 66 aa, Neisseria gonorrhoeae
LPPCTAEFALFCRNCQQSRRICNKIDKMYKINKIYSNLLRFFQINIAVLSKMRIILSIFLLRADLF

SEQ ID NO: 5221 - DNA, 885 bp, Neisseria gonorrhoeae
atgaaatacaaaagaatcgtatttaaagtcggcacatcttcgattacccgttcggacggcagcctctcgcgcggcaaaatccaaaccatcacccgccagcttgccgcattgcatcatgcgggacacgagctggtcttggtgtcttccggcgcggttgctgcagggttcggcgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgtgccgactttgccgacaaacgccgctaccaaaatgccggcggcgcactttccgtgctgctgcaacgccgcgcgattcccatcatcaatgaaaacgacacggtttcggttgaggagttgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcactcaaacccgattcattggccgaagccgccgaacatcaggcggacggctcgtttttcgtcccccgtgccaaaggtttgcggacacagaagcaatggctggcgttctattccgaaagccggggcagcgtttatgtggacgaaggtgcggaacacgctttgtccgaacaagggaaagcctgc

SEQ ID NO: 5222 - protein, 295 aa, Neisseria gonorrhoeae
MKYKRIVFKVGTSSITRSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAIPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDSLAEAAEHQADGSFFVPRAKGLRTQKQWLAFYSESRGSVYVDEGAEHALSEQGKAC

SEQ ID NO: 5223 - DNA, 219 bp, Neisseria gonorrhoeae
atgtcgggcattgccggaatcgaagggcatttttcccgtatggacaccgtaaccgtgtacagcaaggcaaccaaacagcccctgggcaaagggcgcgtccttttcggctccgccgccgccgaagacctgctcaaatcgcgtaaggcgaaaggcgtgttcatccatcgggacgattggatttccatcacacccgaaatacgcctgcttctgaccgaattt

SEQ ID NO: 5224 - protein, 73 aa, Neisseria gonorrhoeae
MSGIAGIEGHFSRMDTVTVYSKATKQPLGKGRVLFGSAAAEDLLKSRKAKGVFIHRDDWISITPEIRLLLTEF

SEQ ID NO: 5225 - DNA, 1260 bp, Neisseria gonorrhoeae
atgtcaaacacacaaaaacagcttgcccttgccaaagcggcaaaaaaatccgtcaacacggcggatgcggaagaaaaaaaccgcgcgctgcttgctatggcggacagtctggaagcggcggcggaagatattttggcggcaaaccgtttggatttgaaagcggcggcaggcaaaattcccgacagcatgaccgaccgccttttgttggacggcaaacgcatttgcgcgatggcggacggcatcagggcggttgccgcgctgcccgaccccgtgggcgaaatactggaaacctcgactctgcccaacggcttggaaatcgtcaaaaagcgcgtggcgatgggcgttatcggcattatttacgaaagccgcccgaacgttacttccgatgcggcggctttggcactgaaaagcggcagcgcggtcgtactccgcagcggcaaagatgcatttcaatccgcacgcgccatcgttgccgccctgaaaacggggttggcacaaacccgcatcgaccccgaagccgtacagctcatcgaagacacagggcgtgagggcagttacgaaatgatgagggcgaaagattatctagacctgctgattccgcgcggcggggcagggctgatacgggcggtggttgaaaatgccgtcgtgccggtcattgaaacggggacgggcatcgtccacatttatatcgacaaggacgcggattgggacaaggcactccgtatcgtgtacaacgccaaaaccggccgcccgtccgtgtgcaactcgatggaagtgctgctggtgcatgaaggcattgctgccgacttcctgcccaagctcgaacggctgttggttcgcggccgtatagaagccggactgccgcccgtccgcttccgtttggatccgcaggcggcgcggtatatcggcggcgaagcggcgggtgcagacgatttcgataccgagtttttagactacatcctcgccgtgaaaaccgtcgcttcggttgaagaggcggtcgggcacatcgaagcccgcggcacgcaccattcagacggcatcgttaccgaaaaccgccacgctgcggactatttcacgacccatatcgattctgccgccgtgtatatcaacgcgtccacgcgcttcaccgacggcggcgaattcggcttgggttgcgaaatgggcatctccacgcaaaaactccacgcccggggcccgatgggtttgaaagagctgacgagttacaaatacatcgtacaaggcacgggacaggttagggaa

SEQ ID NO: 5226 - protein, 420 aa, Neisseria gonorrhoeae
MSNTQKQLALAKAAKKSVNTADAEEKNRALLAMADSLEAAAEDILAANRLDLKAAAGKIPDSMTDRLLLDGKRICAMADGIRAVAALPDPVGEILETSTLPNGLEIVKKRVAMGVIGIIYESRPNVTSDAAALALKSGSAVVLRSGKDAFQSARAIVAALKTGLAQTRIDPEAVQLIEDTGREGSYEMMRAKDYLDLLIPRGGAGLIRAVVENAVVPVIETGTGIVHIYIDKDADWDKALRIVYNAKTGRPSVCNSMEVLLVHEGIAADFLPKLERLLVRGRIEAGLPPVRFRLDPQAARYIGGEAAGADDFDTEFLDYILAVKTVASVEEAVGHIEARGTHHSDGIVTENRHAADYFTTHIDSAAVYINASTRFTDGGEFGLGCEMGISTQKLHARGPMGLKELTSYKYIVQGTGQVRE

SEQ ID NO: 5227 - DNA, 108 bp, Neisseria gonorrhoeae
ttgatttttttgcaaatagaaatgccgtctgaagactgtttcagacggcatttttatagtggattaacaaaaatcaggacaaggcggcgaagccgcagacagtacaaa

SEQ ID NO: 5228 - protein, 36 aa, Neisseria gonorrhoeae
LIFLQIEMPSEDCFRRHFYSGLTKIRTRRRSRRQYK

SEQ ID NO: 5229 - DNA, 3219 bp, Neisseria gonorrhoeae
ttggaaaatcatggtaatgccgcaaagattaagggaaggggcggctattatactgtcggcgggggcaaaccgaaagccgaatcggtttcggcagaattgccggccggttgtttttttttgggctggaaacacgttaaaataaactcggttaatcgtttgtcttgcgggaaacggcatatgttttggatagttttgatcgttattttgttgcttgcgcttgccggcctgttttttgtccgcgcacaatccgaacgcgagtggatgcgcgaggtttctgcgtggcaggaaaagaaaggggaaaaacaggcggagctgcctgaaatcaaagacggtatgcccgattttcccgagttttccctgatgcttttccatgccgtcaaaacggcagtgtattggctgtttgtcggtgtcgtccgtttctgccgaaactatctggcgcacgaatccgaaccggacaggcccgttccgcctgcttctgcaaaccgtgcggatgttccgaccgcatccgacgggtattcagacagtggaaacgggacggaagaagcggaaacggaagcagcagaagctgcggaggaagaggctgccgatacggaagacattgcaactgccgtaatcgacaaccgccgcatcccattcgaccggagtattgctgaagggttgatgcagtctgaaagcaaaacttcgcccgtccgtccggtttttaaggaaatcactttggaagaagcaacgcgtgctttaagcagcgcggctttaagggaaacgaaaaaacgctatatcgatgcatttgagaaaaacggaacagccgtccccaaagtacgcgtgtccgataccccgatggaagggctgcagattatcggtttggacgaccctgtgcttcaacgcacgtattcccgtatgtttgatgcggacaaagaagcgttttccgagtctgcggattacggatttgagccgtattttgagaagcagcatccgtctgccttttctgcagtcaaagccgaaaatgcacggaatgcgccgttccgccgtcatgcagggcaggagaaagggcaggcggaggcaaaatccccggatgtttcccaagggcagtccgtttcagacggcacagccgtccgcgatgcccgccgccgcgtttccgtcaatttgaaagaaccgaacaaggcaacggtttctgcggaggcgcggatttcgcgcctgattccggaaagtcggacggttgtcgggaaacgggatgtcgaaatgccgtctgaaaccgaaaatgttttcacggaaaccgtttcgtctgtgggatacggcggtccggtttatgatgaagctgccgatatccatattgaagagcctgccgcgcccgatgcttgggtggtcgaaccacccgaagtgccggaggtagccgtacccgaaatcgatattctgccgccgcctcccgtatcggaaatctacaaccgtacctatgagccgccggcaggattcgagcaggcgcaacgcagccgcattgccgaaaccgaccatcttgccgctgatgttttgaatggaggttggcaggaggaaaccgccgctattgcagatgacggcagtgagggtgcggcagagcggtcaagcgggcaatatctgtcggaaaccgaagcgttcgggcatgacagtcaggcggtttgtccgtttgaagatgtgccgtctgaacgcccgtcctgccgggtatcggatacggaagcggatgaaggggcgttccaatcggaagagaccggtgcggtatccgaacacctgccgacaaccgacctgcttctgcctccgctgttcaatcccgaggcgacgcaaaccgaagaagaactgttggaaaacagcatcaccatcgaagaaaaattggcggagttcaaagtcaaggtcaaggttgtcgattcttattccggccccgtgattacgcgttatgaaatcgaacccgatgtcggcgtgcgcggcaattccgttctgaatttggaaaaagacttggcgcgttcgctcggcgtggcttccatccgcgttgtcgaaaccatccccggcaaaacctgcatgggtttggaacttccgaacccgaaacgccaaatgatacgcctgagcgaaattttcaattcgcccgagtttgccgaatccaaatccaagctgacgctcgcgctcggtcaggacattaccggacagcccgtcgtaaccgacttgggcaaagcaccgcatttgctggttgccggcacgaccggttcgggcaaatcggtgggtgtcaacgcgatgattctgtctatgcttttcaaagccgcgccggaagacgtgcgtatgattatgatcgatccgaaaatgctggaattgagcatttacgaaggcatcacgcacctgctcgcccctgtcgttaccgatatgaagctggcggcaaacgcgctgaactggtgtgttaacgaaatggaaaaacgctaccgcctgatgagctttatgggcgtgcgcaatcttgcgggcttcaaccaaaaaatcgccgaagccgcagcaaggggagaaaaaatcggcaatccgttcagcctcacgcccgacgatcccgaacctttggaaaaactgccgtttatcgtggtcgtggtcgatgagtttgccgatttgatgatgacggcaggcaagaaaatcgaagaactgattgcgcgcctcgcccaaaaagcccgcgcggcaggcatccaccttatccttgccacacaacgccccagcgtcgatgtcatcacgggtctgattaaggcgaacatcccgacgcgtatcgcgttccaagtgtccagcaaaatcgacagccgcacgattctcgaccaaatgggcgcggaaaacctgctcggtcagggcgatatgctgttcctgccgccgggtactgcctatccgcagcgcgttcacggcgcgtttgcctcggatgaagaggtgcaccgcgtggtcgaatatctgaagcagtttggcgagccggactatgttgacgatattttgagcggcggcggcagcgaagagctgcccggcatcgggcgcagcggcgacggcgaaaccgatccgatgtacgacgaggccgtatccgttgtcctgaaaacgcgcaaagccagcatttcgggcgtacagcgcgccttgcgcatcggctacaaccgcgccgcgcgtctgattgaccaaatggaagcggaaggcattgtgtccgcaccggaacacaacggcaaccgtacgattctcgtccccttggacaatgct

SEQ ID NO: 5230 - protein, 1073 aa, Neisseria gonorrhoeae
LENHGNAAKIKGRGGYYTVGGGKPKAESVSAELPAGCFFLGWKHVKINSVNRLSCGKRHMFWIVLIVILLLALAGLFFVRAQSEREWMREVSAWQEKKGEKQAELPEIKDGMPDFPEFSLMLFHAVKTAVYWLFVGVVRFCRNYLAHESEPDRPVPPASANRADVPTASDGYSDSGNGTEEAETEAAEAAEEEAADTEDIATAVIDNRRIPFDRSIAEGLMQSESKTSPVRPVFKEITLEEATRALSSAALRETKKRYIDAFEKNGTAVPKVRVSDTPMEGLQIIGLDDPVLQRTYSRMFDADKEAFSESADYGFEPYFEKQHPSAFSAVKAENARNAPFRRHAGQEKGQAEAKSPDVSQGQSVSDGTAVRDARRRVSVNLKEPNKATVSAEARISRLIPESRTVVGKRDVEMPSETENVFTETVSSVGYGGPVYDEAADIHIEEPAAPDAWVVEPPEVPEVAVPEIDILPPPPVSEIYNRTYEPPAGFEQAQRSRIAETDHLAADVLNGGWQEETAAIADDGSEGAAERSSGQYLSETEAFGHDSQAVCPFEDVPSERPSCRVSDTEADEGAFQSEETGAVSEHLPTTDLLLPPLFNPEATQTEEELLENSITIEEKLAEFKVKVKVVDSYSGPVITRYEIEPDVGVRGNSVLNLEKDLARSLGVASIRVVETIPGKTCMGLELPNPKRQMIRLSEIFNSPEFAESKSKLTLALGQDITGQPVVTDLGKAPHLLVAGTTGSGKSVGVNAMILSMLFKAAPEDVRMIMIDPKMLELSIYEGITHLLAPVVTDMKLAANALNWCVNEMEKRYRLMSFMGVRNLAGFNQKIAEAAARGEKIGNPFSLTPDDPEPLEKLPFIVVVVDEFADLMMTAGKKIEELIARLAQKARAAGIHLILATQRPSVDVITGLIKANIPTRIAFQVSSKIDSRTILDQMGAENLLGQGDMLFLPPGTAYPQRVHGAFASDEEVHRVVEYLKQFGEPDYVDDILSGGGSEELPGIGRSGDGETDPMYDEAVSVVLKTRKASISGVQRALRIGYNRAARLIDQMEAEGIVSAPEHNGNRTILVPLDNA

SEQ ID NO: 5231 - DNA, 2748 bp, Neisseria gonorrhoeae
atgttattcaacgcaacgcaggccgaagagctgcgcgttgccatcgtcgacggacaaaacctgctggatttggacatcgaaacgctgggcaaagaacagcgcaaaggcaatatctacaaaggcatcattacccgcatcgagccgtcgctggaagcgtgtttcgtcgattacggaaccgaccgccacggctttttgccgtttaaagaagtatcgcgttcgtatttcctcggctacgaaggcgggcgcgcgcgcattcaggacgtgctcaaagaaggcatggaagtcatcgtccaagtcgaaaaagacgagcgcggcaacaaaggcgcggcgctgaccaccttcatcagcctcgccggacgctatctggtattgatgccgaacaatccgcgcggcggcggcgtatcccgccgtatcgaaggcgaagagcgtcaagaactcaaagccgcgatggcgcaactcgacattccgaacggcatgagcatcatcgcgcgtaccgccggcatcggccgcagcgcggaagagttggaatgggatttgaactacctcaaacaactctggcaggcaatcgaagaagcaggaaaagcgcatcacgacccctacctgctctttatggaaagctcgttgctcatccgcgccatccgcgactacttccgtcccgacatcggcgaaattttggtggacaatcaagaagtttacgaccaagttgccgagttcatgagctacgtcatgccgggcaacgcaggtcgtctgaaactctacgaagaccacacgccgctgttttcccgcttccaaatcgaacaccagatcgaaagcgcgttctcgcgcagcgtcagcctgccctccggcggcgcgatcgtcatcgaccacaccgaagccctcgtctccatcgacgtgaactccgcacgcgccacacgcggcgcggacatcgaagacaccgccttcaaaaccaatatggaagctgccgaagaagtcgcccgacaaatgcgcctgcgcgacttgggcggcttggtcgtcatcgacttcatcgacatggaaaaccccaaacaccagcgcgatgtggaaaacgtcctgcgcgacgcactcaaaaaagaccgcgcccgcgtacagatgggcaaactctcccgtttcggacttttggaattgagccgccaacgcctgaaacccgctttgggcgaaagcagccacgccgcctgtccgcgctgcgccggcaccggcgtgatccgcggcatcgaatccaccgccctgcacgttttgcgcatggttcaggaagaagcgatgaaggacaacaccggcgaagtgcgcgcccaagtgcccgtcgatgtcgccaccttcctgctgaacgaaaaacgcgccgagctgtttgcaatggaagagcgtttggatgtgaacgtcgtcctgattccgaacatccacctcgaaaatccgcactacgaaatcaaccgcatccgcaccgacgacgtagaagaagacggcgaaccgagctacaagcgcgttgccgagcctgaagaagacgaatccgccaaacctttcggcggcgaaaaagccaaagccgcccgccccgaacccgccgtcaaaggcgtgcgccacaccagccccgccccgactgccgcccccgagaaaaaaacctcctggtgggacagcttcaaagcatggctcaaacgcattttcggcggcagcgaaacccaagccgtacccgctgccgaaacctccgaaaaacgcagcacggcaaaccgcagcggcagccgcgccaacaaccgccgccaaaacccgcgccgcagcaaacgcgaaggcagcaaaatagaagtccgcgaagcggcgggcaaaactgccggacagaaagcgcgcgccgacaaagccgaaacgcgcaacaacggcaaccgccgccgcaacgaacgcggcgaccgtgccaccgaacgcgccaacgaagcggaaatccaaagccgcaacgtacagcctgccgcacccgttgcagatgccgcaccgcccgaaaccgaaggtcaaaccggaaaacgccgccgcaacggcagccgcaacgaacgtggccaaaccgcaccggaaaccgccgccgttgccgaaacagccgttcagacagcggaaaacacgccgcccgaaccgtataccgcagaagacaaaggcagcaagcccaaatccgaacgcaaccgccgcgaacgcgacagccgcgatgccaaagaacgccgcgaacgcaacaatcagcgcgaccgccgtcaaaacggcaaaaaacgcaatatcccgtctgccgccaaaatcgagcagtacctgaatattcacgacaccgccgacaaagtccgttccgccgccgcgcacgttttcggcgaaaccgacgcaaacgcgccgattaccgtcagcattgccgatccgctcatcgccacacccgttcagacggcatcttccgccgtttcaaacggcgacgcactgatttatgatgcggcggaaaaaatccgccgtgccgccgccgacatcctgcccgaaggcgcggcaccgaaagccgcagcacaggaaatgccgtctgaaaccgcaacctttacggctgcggcggaacaggcacgggaaaccgcacaaaccggcggactcgtcctgatcgaaaccgaccctgccgcattgaaggcatgggcggcacaacccgaagtccaagccggacgcggtttgcgccgttccgaacagccaaaaccgtctgaagccgcaaccgtccctgccgaagaaatgatccaagtcgaaacccggcaaggc

SEQ ID NO: 5232 - protein, 916 aa, Neisseria gonorrhoeae
MLFNATQAEELRVAIVDGQNLLDLDIETLGKEQRKGNIYKGIITRIEPSLEACFVDYGTDRHGFLPFKEVSRSYFLGYEGGRARIQDVLKEGMEVIVQVEKDERGNKGAALTTFISLAGRYLVLMPNNPRGGGVSRRIEGEERQELKAAMAQLDIPNGMSIIARTAGIGRSAEELEWDLNYLKQLWQAIEEAGKAHHDPYLLFMESSLLIRAIRDYFRPDIGEILVDNQEVYDQVAEFMSYVMPGNAGRLKLYEDHTPLFSRFQIEHQIESAFSRSVSLPSGGAIVIDHTEALVSIDVNSARATRGADIEDTAFKTNMEAAEEVARQMRLRDLGGLVVIDFIDMENPKHQRDVENVLRDALKKDRARVQMGKLSRFGLLELSRQRLKPALGESSHAACPRCAGTGVIRGIESTALHVLRMVQEEAMKDNTGEVRAQVPVDVATFLLNEKRAELFAMEERLDVNVVLIPNIHLENPHYEINRIRTDDVEEDGEPSYKRVAEPEEDESAKPFGGEKAKAARPEPAVKGVRHTSPAPTAAPEKKTSWWDSFKAWLKRIFGGSETQAVPAAETSEKRSTANRSGSRANNRRQNPRRSKREGSKIEVREAAGKTAGQKARADKAETRNNGNRRRNERGDRATERANEAEIQSRNVQPAAPVADAAPPETEGQTGKRRRNGSRNERGQTAPETAAVAETAVQTAENTPPEPYTAEDKGSKPKSERNRRERDSRDAKERRERNNQRDRRQNGKKRNIPSAAKIEQYLNIHDTADKVRSAAAHVFGETDANAPITVSIADPLIATPVQTASSAVSNGDALIYDAAEKIRRAAADILPEGAAPKAAAQEMPSETATFTAAAEQARETAQTGGLVLIETDPAALKAWAAQPEVQAGRGLRRSEQPKPSEAATVPAEEMIQVETRQG

SEQ ID NO: 5233 - DNA, 1509 bp, Neisseria gonorrhoeae
atgaaatggttgaaacgcctgacggtcattgtcgggactttttaccgctatcggctggcaggtctgtgcgtttcgctgatgggtagcggttggatatgcgctctgctgaaaatgatgccgcagtcgtccaaattgaaaaacgaaccgcctgccgtccgtctgcgccttgccttggaaagcctggggccgattttcatcaagttcgggcaggttttgtccacacgccccgatttgattccgcacgattacgccgtcgaactggcaaagctgcaagacaaagtgccgccttttgacgcgcggctttcgcgtgaacaaatcgaaaaatcgctgggtcagcccatcgaaaagctgtatgcggaatttgaaaccgagcccgtcgccagcgcgtccatcgcccaagtacacaaagcccgcctgcattcgggcgaacgagtggcggtcaaagttttgcgccccaacctcttgccccttatcgaacaagacttgtcgctgatgcgtttcggcgcggcttgggtcgaacgcttgttttcagacggcaagcgtctgaagccgcgcgaagtggtggcggagttcgacaaatacctgcacgacgaattggatttgatgcgcgaagccgccaatgcaggacaactcgggcgcaatttccaaaacagcaatatgctgattgtgcccaaggtgttttacgactactgcacaagcgacgtgctgacgattgaatggatggacggcacgccggtttccgacatcgccaaactcaaagcagacggcatcgatttgcacaaacttgccgattacggcgtggaaatctttttcacgcaagttttccgcgacggctttttccacgcggatatgcaccccggcaatattttggttgccgccgacaaccgctatatcgcccttgatttcggcatcgtcggtacgctgaccgattacgacaaacgctatctcgccatcaatttcctcgcctttttcaaccgcgattaccgacgtgtcgccaccgcccacatcgaatcgggctgggtgcctgccgacacgcgtgcggaagagttggaagcggcggttcgcgccgtgtgcgagcctgtgttcaacaaaccgatttcgcagatttccttcggcttggtactgatgcgcctgtttgaagtcagccgccgcttcaatgtcgaaatccagccgcagctggtattgctgcaaaaaacgctgctcaacatcgaaggcttgggccgccaactcgatcccgatttggacttgtggaaaaccgccaaaccgtttttggtaaaatggatgaacgggcaggtcggtcccaaagccctttggcgcaacctcaaaaacgaagccccagactgggcgcaaatcatcccttccctgccgcgcaaaatcaatgccttggtcgatgaggcgcgccggcaggaaatgcgcgatgcctatatccatttggtcaaagtgcagcagcggcaaagcctgtggctggcagcgatagcggttgttttgctgctgattttgcttttgaaa

SEQ ID NO: 5234 - protein, 503 aa, Neisseria gonorrhoeae
MKWLKRLTVIVGTFYRYRLAGLCVSLMGSGWICALLKMMPQSSKLKNEPPAVRLRLALESLGPIFIKFGQVLSTRPDLIPHDYAVELAKLQDKVPPFDARLSREQIEKSLGQPIEKLYAEFETEPVASASIAQVHKARLHSGERVAVKVLRPNLLPLIEQDLSLMRFGAAWVERLFSDGKRLKPREVVAEFDKYLHDELDLMREAANAGQLGRNFQNSNMLIVPKVFYDYCTSDVLTIEWMDGTPVSDIAKLKADGIDLHKLADYGVEIFFTQVFRDGFFHADMHPGNILVAADNRYIALDFGIVGTLTDYDKRYLAINFLAFFNRDYRRVATAHIESGWVPADTRAEELEAAVRAVCEPVFNKPISQISFGLVLMRLFEVSRRFNVEIQPQLVLLQKTLLNIEGLGRQLDPDLDLWKTAKPFLVKWMNGQVGPKALWRNLKNEAPDWAQIIPSLPRKINALVDEARRQEMRDAYIHLVKVQQRQSLWLAAIAVVLLLILLLK

SEQ ID NO: 5235 - DNA, 552 bp, Neisseria gonorrhoeae
ttgtggagaaaatatgctcaaaataaccataattgcggcgtgtgcggaaaacctgtgcatcggggcgggcaatgctatgccttggcacatccccgaagatttcgcatttttcaaagcctataccttgggcaaacccgtcattatggggcggaaaacgtgggaatccctgcccgtcaaacccctgcccggacggaggaacatcgtcatcagccggcaggcggattattgcgcggcaggcgcggaaacggtggcaagtttggaggtggcattggcattgtgcgccggcgcggaagaagccgtcattatgggcggcgcgcagatatacggacaagcgatgccattagcgaccgatttgcggataaccgaagtggatttgtctgtggaaggagatgcatttttcccagaaatagaccggacgcattggagagaagcagagcggacggaacgccgtgtcagcagcaaaggcgttgcatatacattcgtgcattacctcaagggataaccgcaaggcagatgccgtctgaagccgcttcagacggcatttttccagct

SEQ ID NO: 5236 - protein, 184 aa, Neisseria gonorrhoeae
LWRKYAQNNHNCGVCGKPVHRGGQCYALAHPRRFRIFQSLYLGQTRHYGAENVGIPARQTPARTEEHRHQPAGGLLRGRRGNGGKFGGGIGIVRRRGRSRHYGRRADIRTSDAISDRFADNRSGFVCGRRCIFPRNRPDALERSRADGTPCQQQRRCIYIRALPQGITARQMPSEAASDGIFPA

SEQ ID NO: 5237 - DNA, 678 bp, Neisseria gonorrhoeae
atgattttccaaacagtctggttttcagatgtggtactgtcggtttcgtggattgtccttatcctgatactggcagcttccgcgccgtcggcattccgttcgcttgcccgctaccgttccgcccttcccctgtgtaccgtaattttttccgcagcatggtgtctgaacgcctctgtcggcggcggacagcttgcccagatgaactaccacctgcttgccgtcaatctggttacactgatggtggatacctccgccgccctttggcttgccgcgctgctgatgctgccctactgcctgctgtttgccggttctgccggcgcatatccgccgaacgctttggtgctgatactgcccgcgcttgtcgtcaaccgcctgtcgcgtatgctggtcaaccgtctgccgcccaatattttcatctttattttcgtcaacggctttctcgcttccgccgccggcattctgctgaccgggctggtgctgatcggtattttggatgccgcaaacgcttttccgtccgaaatattgtggacggtcgccctgcccgtctttattctgctggcgtgggcggaagccttcctcagcggcatttcaactgccattttcgtggcactgaagccccattggatcaacactttcgacgacaaccgctatctgaagtccgagcgcggcatatggctg

SEQ ID NO: 5238 - protein, 226 aa, Neisseria gonorrhoeae
MIFQTVWFSDVVLSVSWIVLILILAASAPSAFRSLARYRSALPLCTVIFSAAWCLNASVGGGQLAQMNYHLLAVNLVTLMVDTSAALWLAALLMLPYCLLFAGSAGAYPPNALVLILPALVVNRLSRMLVNRLPPNIFIFIFVNGFLASAAGILLTGLVLIGILDAANAFPSEILWTVALPVFILLAWAEAFLSGISTAIFVALKPHWINTFDDNRYLKSERGIWL

SEQ ID NO: 5239 - DNA, 357 bp, Neisseria gonorrhoeae
atgctttccaacatcctccccctttccatcggtgcaatattcggcacaacggcgcgttggctgctcaacctcgccgtccccgcatcgttgtctcccgccacaggcaacctgtttgccaactggacgggcgcgctgctcatcggcatctttgccgaaaccgtcagccatccgcaatggaagctgctgctgattaccggttttttcggcagcctgaccacgctttccggattttcactggaaaccgtaaccctgctccaatcgaaccgtcccgcttcggcacttgccaatattttcctacacacggcaggttcgctgctgctgacttggctcgggctgaagatagggacggcagtcaaa

SEQ ID NO: 5240 - protein, 119 aa, Neisseria gonorrhoeae
MLSNILPLSIGAIFGTTARWLLNLAVPASLSPATGNLFANWTGALLIGIFAETVSHPQWKLLLITGFFGSLTTLSGFSLETVTLLQSNRPASALANIFLHTAGSLLLTWLGLKIGTAVK

SEQ ID NO: 5241 - DNA, 414 bp, Neisseria gonorrhoeae
atgtcaaaaccaaaggaagcaattttttgcggttatttgactgccgtccctatcttcagcccgagccaagtcagcagcagcgaacctgccgtgtgtaggaaaatattggcaagtgccgaagcgggacggttcgattggagcagggttacggtttccagtgaaaatccggaaagcgtggtcaggctgccgaaaaaaccggtaatcagcagcagcttccattgcggatggctgacggtttcggcaaagatgccgatgagcagcgcgcccgtccagttggcaaacaggttgcctgtggcgggagacaacgatgcggggacggcgaggttgagcagccaacgcgccgttgtgccgaatattgcaccgatggaaagggggaggatgttggaaagcatggttttgtctgcctatgccgtc

SEQ ID NO: 5242 - protein, 138 aa, Neisseria gonorrhoeae
MSKPKEAIFCGYLTAVPIFSPSQVSSSEPAVCRKILASAEAGRFDWSRVTVSSENPESVVRLPKKPVISSSFHCGWLTVSAKMPMSSAPVQLANRLPVAGDNDAGTARLSSQRAVVPNIAPMERGRMLESMVLSAYAV

SEQ ID NO: 5243 - DNA, 135 bp, Neisseria gonorrhoeae
atgaatatcttcgttactgatttttcttactggtttatgagtttattaacgctttcttatataccgtccgttcattcatcggatgatgatattgattttggcaaaaggattatgacggttacttttttgcatttt

SEQ ID NO: 5244 - protein, 45 aa, Neisseria gonorrhoeae
MNIFVTDFSYWFMSLLTLSYIPSVHSSDDDIDFGKRIMTVTFLHF

SEQ ID NO: 5245 - DNA, 381 bp, Neisseria gonorrhoeae
atgacgaaaaggtcgttttggtgccggcagtggcgttatgcggcaaatcaggcgacattggaacttcctgcgggcaagctggatgtggcgggcgaggatatggcagcgtgtgcgctgcgagaattggcggaggaaacgccttatgttgccgacagcgtgcgcctgctgtacagtttttatacggcggtcggtttttgcaatgaaaaaatgtatctgttcgaggcggaaggcgtgcgcttgggcagtacgctttctaatgatgaagatgaaataacggaaaccgtgctgatgtcgaaagatgaagtccgtcaggcattggcaaacgatgaaattaaagacggtaaaacattaatcggtttgcaatactggctgatgaaggat

SEQ ID NO: 5246 - protein, 127 aa, Neisseria gonorrhoeae
MTKRSFWCRQWRYAANQATLELPAGKLDVAGEDMAACALRELAEETPYVADSVRLLYSFYTAVGFCNEKMYLFEAEGVRLGSTLSNDEDEITETVLMSKDEVRQALANDEIKDGKTLIGLQYWLMKD

SEQ ID NO: 5247 - DNA, 354 bp, Neisseria gonorrhoeae
gtggatttgagggaagtaaaattaggcggcgaaaccatttacgagggcggtttcgtcagtatcagcagggataaggtcaggctgcccaacggcaatgaagggcagcgcatcgtcatccggcatccgggcgcggcgtgcgtgttggcggtaacggatgacgaaaaggtcgttttggtgccggcagtggcgttatgcggcaaatcaggcgacattggaacttcctgcgggcaagctggatgtggcgggcgaggatatggcagcgtgtgcgctgcgagaattggcggaggaaacgccttatgttgccgacagcgtgcgcctgctgtacagtttttatacggcggtcggtttttgcaa

SEQ ID NO: 5248 - protein, 118 aa, Neisseria gonorrhoeae
VDLREVKLGGETIYEGGFVSISRDKVRLPNGNEGQRIVIRHPGAACVLAVTDDEKVVLVPAVALCGKSGDIGTSCGQAGCGGRGYGSVCAARIGGGNALCCRQRAPAVQFLYGGRFLQ

SEQ ID NO: 5249 - DNA, 354 bp, Neisseria gonorrhoeae
atggataaaatctttttgcacggcatgaaggcggatacgcttatcggcgtgtacggctgggaacgcgaacggttgcagaccctgattgtcgatttggacatcggcgttcccgagaaagcgggttcggacgacgatattgccaatacggtgcattatgccgaggtatgcgaaacgctgcgccgacatctgaaagaacaggatttcctgcttttggaagcgttggcggaatatattgccgatttggttttgggatatttcggcgcggtgtgggtgcacgtgaaaatcgtcaagccgggtattttggaaggcgtgcgcgaggttggagtggaaatcgagcgcggcaagcgtgaagat

SEQ ID NO: 5250 - protein, 118 aa, Neisseria gonorrhoeae
MDKIFLHGMKADTLIGVYGWERERLQTLIVDLDIGVPEKAGSDDDIANTVHYAEVCETLRRHLKEQDFLLLEALAEYIADLVLGYFGAVWVHVKIVKPGILEGVREVGVEIERGKRED

SEQ ID NO: 5251 - DNA, 300 bp, Neisseria gonorrhoeae
  MISC_FEATURE (1)..(300): n = g, a, t, or c
atgaccgtcaggcgtttcaaccatttcatatataaaatcccgaatacagcatttatcggacaatcaaaaaatcttaccgagcacatagcccataaaggcaatcagcaacccgaaaaccagcggtttgatattgccgggcggctcgggttgccaacatacngaaatatcatcttcccgcccgccgtgaagttcaagatattcgggcatttccccatccgcgcctcctccttcgccctccccctcctccggcggcacgaccgtttccaactccatatacgggtaataatatccaaacccaaa

SEQ ID NO: 5252 - protein, 100 aa, Neisseria gonorrhoeae
  MISC_FEATURE (1)..(100): Xaa = any amino acid
MTVRRFNHFIYKIPNTAFIGQSKNLTEHIAHKGNQQPENQRFDIAGRLGLPTYXNIIFPPAVKFKIFGHFPIRASSFALPLLRRHDRFQLHIRVIISKPK

SEQ ID NO: 5253 - DNA, 588 bp, Neisseria gonorrhoeae
gtgcgaacacaaaacgtatggcgcgcgcaggttgagatttttgacgcagaatgtcataaaatgccgtctgaagcgttcagacggcatttttgtggagaaaatatgctcaaaataaccataattgcggcgtgtgcggaaaacctgtgcatcggggcgggcaatgctatgccttggcacatccccgaagatttcgcatttttcaaagcctataccttgggcaaacccgtcattatggggcggaaaacgtgggaatccctgcccgtcaaacccctgcccggacggaggaacatcgtcatcagccggcaggcggattattgcgcggcaggcgcggaaacggtggcaagtttggaggtggcattggcattgtgcgccggcgcggaagaagccgtcattatgggcggcgcgcagatatacggacaagcgatgccattagcgaccgatttgcggataaccgaagtggatttgtctgtggaaggagatgcatttttcccagaaatagaccggacgcattggagagaagcagagcggacggaacgccgtgtcagcagcaaaggcgttgcatatacattcgtgcattacctcaaggga

SEQ ID NO: 5254 - protein, 196 aa, Neisseria gonorrhoeae
VRTQNVWRAQVEIFDAECHKMPSEAFRRHFCGENMLKITIIAACAENLCIGAGNAMPWHIPEDFAFFKAYTLGKPVIMGRKTWESLPVKPLPGRRNIVISRQADYCAAGAETVASLEVALALCAGAEEAVIMGGAQIYGQAMPLATDLRITEVDLSVEGDAFFPEIDRTHWREAERTERRVSSKGVAYTFVHYLKG

SEQ ID NO: 5255 - DNA, 600 bp, Neisseria gonorrhoeae
atgttcaacataccggccgtcgccgtttcctatttaatcggttcactttctttcgccgtcatcgtttccaagtattacgggatggacgacccgcgcacctacggatcgggcaatcccggcgcgaccaatgttttacgcagcggcaaaaaaaaggcggccgcgctgacgctcttgggcgatgccgccaaaggtttggttgccgttttgcttgcacgcgtgcttcaagaaccgctcggtttatccgacagcgcaatcgccgccgtcgcactcgccgcgctggtcgggcatatgtggccggtgtttttcggatttaagggcggcaaaggcgtggcaacggcattgggcgtgcttctggcactctctcctgcaactgccttggtctgcgcgttgatttggcttgtgatggcattcggcttcaaagtatcctcccttgccgcgctggtcgccacaaccgccgccccccttgccgcactgttttttatgccgcatacttcttggattttcgcaaccctcgcaatcgccatattggtgttgctccgccataagagcaacatcctcaacctgattaaaggcaaagaaagcaaaatcggcgaaaaacgc

SEQ ID NO: 5256 - protein, 200 aa, Neisseria gonorrhoeae
MFNIPAVAVSYLIGSLSFAVIVSKYYGMDDPRTYGSGNPGATNVLRSGKKKAAALTLLGDAAKGLVAVLLARVLQEPLGLSDSAIAAVALAALVGHMWPVFFGFKGGKGVATALGVLLALSPATALVCALIWLVMAFGFKVSSLAALVATTAAPLAALFFMPHTSWIFATLAIAILVLLRHKSNILNLIKGKESKIGEKR

SEQ ID NO: 5257 - DNA, 798 bp, Neisseria gonorrhoeae
atgctcaaacacttcaccttgtttttagtgctgcaatatttcaaccgcaaagacaagccctactggtacatcgacacgcacggcggcgcgggtgtgtacaatctcgaaggcagcgaggcgcagaaagtcggcgaataccggcaaggcatcgccctgctccgacaggcgcaaaacctgcctgccgaactctctgactttgccgcgcacatacaaaaaatcctgccctcgcccgaactttactgcggctctccgtggctggcgcaatcgctgacctgcgtcggcgacaaattgcgcctgtttgagctgcaccccaccgactttgtccatctgcaaaacaatatgggcgaagcgggattgggcaaacgcggacaagtgttgcgcgaagacggttacaaagggctgatttccctgctgccgcccccgccgcgccgcgccgccgtcctcatcgacccgccctatgaggaaaaacaggactaccggcgtgtaacggaaacgctgaaagccgctttaaaacggtttgagtccggctgttatctcatttggtatccctgcctcagccgcgaagaaagccgcaagctgccggaagaattgaaaaaactcctgcccgacaactacctttacgccgaactgcacgtccacgcgccgaaaaccgacggtttcggtatgcacggcagcggaatgttcgtgattaatcccccttaccttttagccgaacaattggcggcaaacctccccgccctgacgcggctgcttgcgcaagacgaaggcgcgcgctaccttttggacagcaaaatccgc

SEQ ID NO: 5258 - protein, 266 aa, Neisseria gonorrhoeae
MLKHFTLFLVLQYFNRKDKPYWYIDTHGGAGVYNLEGSEAQKVGEYRQGIALLRQAQNLPAELSDFAAHIQKILPSPELYCGSPWLAQSLTCVGDKLRLFELHPTDFVHLQNNMGEAGLGKRGQVLREDGYKGLISLLPPPPRRAAVLIDPPYEEKQDYRRVTETLKAALKRFESGCYLIWYPCLSREESRKLPEELKKLLPDNYLYAELHVHAPKTDGFGMHGSGMFVINPPYLLAEQLAANLPALTRLLAQDEGARYLLDSKIR

SEQ ID NO: 5259 - DNA, 330 bp, Neisseria gonorrhoeae; identical to SEQ ID NO: 281

SEQ ID NO: 5260 - protein, 110 aa, Neisseria gonorrhoeae; identical to SEQ ID NO: 282

SEQ ID NO: 5261 - DNA, 456 bp, Neisseria gonorrhoeae
atgccgtctgaacccttcagacggcatcttccgtcaaacaaacaaaaccgggcgatacacactccatatcgtccggttctgcataaaaccagtattcaaaaatcagaacacgcttttcattacacccacggtaccaaccacaccgttcagcagcatcagaccaccggcagccgtacccataccttgacggattgcgtcatgcttattggcacgtttttcacgttccaaagccaactcctcagaaacatttttacgttgacggcggtgttgcgccagttccgcacggctaattcgcgcttcggcacggttacgaccagccttgattacggccgaatcgtcgccgatagcatagttggctacagaattttcagaagcgcaggcagcaagcaaaacggcacacacagcaacaacggaaatatttttcaagtttttcatacctgtcctattatctcaaaa

SEQ ID NO: 5262 - protein, 152 aa, Neisseria gonorrhoeae
MPSEPFRRHLPSNKQNRAIHTPYRPVLHKTSIQKSEHAFHYTHGTNHTVQQHQTTGSRTHTLTDCVMLIGTFFTFQSQLLRNIFTLTAVLRQFRTANSRFGTVTTSLDYGRIVADSIVGYRIFRSAGSKQNGTHSNNGNIFQVFHTCPIISK

SEQ ID NO: 5263 - DNA, 246 bp, Neisseria gonorrhoeae
atgaaaatgaagaaactgattttgttgtcggtggctgcgatgttggtgacggcatgtacttacgcagaccgccgttttgtaactcaagaatctgcagcggaaatacaggcgaaaagtcgtgccattcagataagcgagcgtgccgagcgtgccgaataccgtaaagaacgccgggaagaaatgatggatgcggcacgcgccatcaaaaaggcaaacgaaaattcacccaatatttattttatccga

SEQ ID NO: 5264 - protein, 82 aa, Neisseria gonorrhoeae
MKMKKLILLSVAAMLVTACTYADRRFVTQESAAEIQAKSRAIQISERAERAEYRKERREEMMDAARAIKKANENSPNIYFIR

SEQ ID NO: 5265 - DNA, 1185 bp, Neisseria gonorrhoeae
atgttatcactatatatatgtataatgtcaatattttttaaaaataaatttggcatcttgtacttctcgatccgcctgccgcgttccgacttgccccgcgccgttttttcccactacaatcccacgcgatatccggcggaacgcaccaaaggaacgccccgcagcaatctgccgcctttcagacggcacaaacctttccgaaacgagcaaaccatggacacactgacccgattcctccccgaacacctgcaacaaaaccaactgcccgaagcactcggcggcgttttgctgtccgtcgtttccgcctgtaccgaaatcaacgccaaagtccgcctcggcgcacttgccggcgtattgggtatggcgggcacgggcaatattcagggtgaagaccagaaaaaactggatgttatcgccaacaacattatgattgacacactcaaagccaaccctgccgttgccggtttggcaagcgaggaagaagacactttcgtaagtgccggtgaaaacggacgctatctcgtcctattcgaccctttagacggatcgtccaatattgatgtcaacatttccgtcggtacgattttctccattctcgccaaacccgaaggcgcattggcaaccgaatcattccttcaaacgggcagacagcagcttgccgcaggctatgtcctctacgggcctcaaacccagctcgtattcacattcggacacggcgtgtacgtatttacactcaatgccgaaaacgaatttgtgctgaccaaagaaaacccgaaagtacccgaaagtaccaaagaattcgccatcaatatgtctaaccgccgccactggctaccccccgttcaacaatacgtcgacgagctcttggcgggcgaaaccggtacgcgcggcaaaaactacaatatgcgctgggtagccagtatggttgccgaaatccaccgcatcctgatgcgcggcggcgtgttcatgtatctgcaagacaaacgcgacccgtccaaacccggcaaactgcgcctgatgtacgaagccaaccctatggccctgatactcgaacaggcgggcgcatcggcaagcaacgcatatcaagccatgctcgatatacagcccgaaagcctgcaccaacgcgtcgccgtcattatgggcagcagcgaagaagtggattacctcaaccgtctgcattcaaaa

SEQ ID NO: 5266 - protein, 395 aa, Neisseria gonorrhoeae
MLSLYICIMSIFFKNKFGILYFSIRLPRSDLPRAVFSHYNPTRYPAERTKGTPRSNLPPFRRHKPFRNEQTMDTLTRFLPEHLQQNQLPEALGGVLLSVVSACTEINAKVRLGALAGVLGMAGTGNIQGEDQKKLDVIANNIMIDTLKANPAVAGLASEEEDTFVSAGENGRYLVLFDPLDGSSNIDVNISVGTIFSILAKPEGALATESFLQTGRQQLAAGYVLYGPQTQLVFTFGHGVYVFTLNAENEFVLTKENPKVPESTKEFAINMSNRRHWLPPVQQYVDELLAGETGTRGKNYNMRWVASMVAEIHRILMRGGVFMYLQDKRDPSKPGKLRLMYEANPMALILEQAGASASNAYQAMLDIQPESLHQRVAVIMGSSEEVDYLNRLHSK

SEQ ID NO: 5267 - DNA, 384 bp, Neisseria gonorrhoeae
gtgaatccgatactgcgccgatatttcaagcataccctccggaaaaacagaaaactgcctttccgaacgataaaaataccgtctgaaaaattttcagacggtattttaaaaattaaagctcaaatttatttgcccgccgctttttgcaggatggcgtacaactcgtctttcagtttcaatttggcttttttcagctcatcgatggtttccgcaccgctggtaaccggattgttggccagaccggtaattttatcgtccagctcgttatgctcgtcgaacagacgggcgaagcgggaattttcctgtttcaatttggaaatcaaatcacggtattctgggaacataatcgctttcctctcttggtttacggttaaaaagtcaaat

SEQ ID NO: 5268 - protein, 128 aa, Neisseria gonorrhoeae
VNPILRRYFKHTLRKNRKLPFRTIKIPSEKFSDGILKIKAQIYLPAAFCRMAYNSSFSFNLAFFSSSMVSAPLVTGLLARPVILSSSSLCSSNRRAKREFSCFNLEIKSRYSGNIIAFLSWFTVKKSN

SEQ ID NO: 5269 - DNA, 207 bp, Neisseria gonorrhoeae
  MISC_FEATURE (1)..(207): n = g, a, t, or c
atggagttggaaacggtcgtgccgccggaggagggggagggcgaaggaggaggcgcggatggggaaatgcccgaatatcttgaacttcacggcgggcgggaagatgatatttcngtatgttggcaacccgagccgcccggcaatatcaaaccgctggttttcgggttgctgattgcctttatgggctatgtgctcggtaagattttt

SEQ ID NO: 5270 - protein, 69 aa, Neisseria gonorrhoeae
MELETVVPPEEGEGEGGGADGEMPEYLELHGGREDDISVCWQPEPPGNIKPLVFGLLIAFMGYVLGKIF

SEQ ID NO: 5271 - DNA, 1053 bp, Neisseria gonorrhoeae
atgacacaccattaccccacagacgatattaagattaaagaagttaaagagttgttgccgccgattgcccatctttacgagctgccgatttccaaagaggcttcgggcttggttcaccgcatccgccaggaactttccgatttggttcacggcagggacaggcggctgttggtcattatcgggccgtgttcgattcacgatccgaaagcggcgttggaatatgcggaacgtctgttgaaactccgcaagcggtatgaaaacgagcttttgatcgtgatgcgcgtttatttcgagaagccgagaacgacggtgggttggaaaggtttgattaacgacccgcatttggacggtacgttcgacatcaatttcggtttgcgtcaggcgcgcagtctgttgttgtccctgaataatatgggcatgcctgcctctaccgaatttttggatatgattacaccccagtattatgccgacctgatttcttggggggcaatcggcgcgcggacgaccgaaagccaagtccaccgcgaattggcaagcggtctgtcctgccccgtcggctttaaaaacggtacggacggcaatttgaagattgcgatcgacgcaatcggtgcggcgagccattcgcatcatttcttgtctgtaaccaaggccgggcattccgccattgtccataccggcggcaatcccgactgtcatgtcattttgcgcggcggaaaagagccgaattatgatgcgggacacgtcagcgaggcggtggaacaactgcgtgcggcaggggtaaccgacaagctgatgatcgattgcagccacgccaacagccgcaaggattacacccggcagatggaagtggcacaagacattgccgaccaattggaacaggacggcggcaatatcatgggcgtgatggtggaaagccatttggtcgaaggcaggcaggacaagccggaagtgtacggcaagagcattaccgatgcgtgtatcggttggggcgcgactgaagaattgttggcattgttggcgggtgcgaacacaaaacgtatggcgcgcgcaggt

SEQ ID NO: 5272 - protein, 351 aa, Neisseria gonorrhoeae
MTHHYPTDDIKIKEVKELLPPIAHLYELPISKEASGLVHRIRQELSDLVHGRDRRLLVIIGPCSIHDPKAALEYAERLLKLRKRYENELLIVMRVYFEKPRTTVGWKGLINDPHLDGTFDINFGLRQARSLLLSLNNMGMPASTEFLDMITPQYYADLISWGAIGARTTESQVHRELASGLSCPVGFKNGTDGNLKIAIDAIGAASHSHHFLSVTKAGHSAIVHTGGNPDCHVILRGGKEPNYDAGHVSEAVEQLRAAGVTDKLMIDCSHANSRKDYTRQMEVAQDIADQLEQDGGNIMGVMVESHLVEGRQDKPEVYGKSITDACIGWGATEELLALLAGANTKRMARAG

SEQ ID NO: 5273 - DNA, 384 bp, Neisseria gonorrhoeae
atgcgtaaagcggaagattgtcaacgattttatcggacggtggggcggttttctgcggacggtgttgccgtgtataacaaaacactggataaaaatattatctttgttataattaatgtaaagattcaatttgactttttaaccgtaaaccaagagaggaaagcgattatgttcccagaataccgtgatttgatttccaaattgaaacaggaaaattcccgcttcgcccgtctgttcgacgagcataacgagctggacgataaaattaccggtctggccaacaatccggttaccagcggtgcggaaaccatcgatgagctgaaaaaagccaaattgaaactgaaagacgagttgtacgccatcctgcaaaaagcggcgggcaaa

SEQ ID NO: 5274 - protein, 128 aa, Neisseria gonorrhoeae
MRKAEDCQRFYRTVGRFSADGVAVYNKTLDKNIIFVIINVKIQFDFLTVNQERKAIMFPEYRDLISKLKQENSRFARLFDEHNELDDKITGLANNPVTSGAETIDELKKAKLKLKDELYAILQKAAGK

SEQ ID NO: 5275 - DNA, 513 bp, Neisseria gonorrhoeae
ttgaattatttagccatattacatacaataatcagcatgctttgtatgaattatcaatcaaactcaggcgaaggagtgcttgtagctaaaacatatttattgactgcattgataatgtctatggtaatctccggatgtcaagtcatccatgccaatcaaggtaaggttaatactaattctgctgtcatcgcaggtgcagacgctcacacgcctgaacatgtaacgggactgaccgaacaaaagcaggtgattgcaagtgattttatagtagcgtcagccaatccattagcaacacaagctggctatgatatcttaaagcaaggcggtagcgctgcagatgcgatggtggcggtgcagacgacactaagcttggtagagccacagtcgtcaggcttgggcggtggtgcatttgtgttgtattgggacaataccgccaaaacattgaccacatttgatgggcgtgagacggcaccgatgcgtgcgacgccagaattatttttggataaagatggt

SEQ ID NO: 5276 - protein, 171 aa, Neisseria gonorrhoeae
LNYLAILHTIISMLCMNYQSNSGEGVLVAKTYLLTALIMSMVISGCQVIHANQGKVNTNSAVIAGADAHTPEHVTGLTEQKQVIASDFIVASANPLATQAGYDILKQGGSAADAMVAVQTTLSLVEPQSSGLGGGAFVLYWDNTAKTLTTFDGRETAPMRATPELFLDKDG

SEQ ID NO: 5277 - DNA, 546 bp, Neisseria gonorrhoeae
ttgccttggggaaaattatttgatacgccgatccacttggcaaaacaaggctttgaggtgtcgccaaggcttgccatctcggttgagcaaaatcagcagcatttggcacgctatccaaaaacagccgcttattttttgccgaatggtgtgccgctacaagcaggcagcttgctgaaaaatttagaatttgctgacagtgttcaggcgttagcagctcaaggtgcaaaagctctgcatactggtaaatatgcccaaaatattgtttcagttgtccaaaatgctaaggataaccccggtcaattatccttgcaagatttatctgattatcaagtggtggaacgcccgcctgtttgtgtgacttatcgtatttatgaagtatgcggtatgggtgcaccaagctcaggtgggattgctatgggtcagattttggggattttaaatgaattttcacccaatcgggtggggtatgatgctgaaggtttgcgtttgcggatcgtgatgtatatttgggcgaccctgattttgtaccagtacccattcgccagt

SEQ ID NO: 5278 - protein, 182 aa, Neisseria gonorrhoeae
LPWGKLFDTPIHLAKQGFEVSPRLAISVEQNQQHLARYPKTAAYFLPNGVPLQAGSLLKNLEFADSVQALAAQGAKALHTGKYAQNIVSVVQNAKDNPGQLSLQDLSDYQVVERPPVCVTYRIYEVCGMGAPSSGGIAMGQILGILNEFSPNRVGYDAEGLRLRIVMYIWATLILYQYPFAS

SEQ ID NO: 5279 - DNA, 708 bp, Neisseria gonorrhoeae
ttgggcgaccctgattttgtaccagtacccattcgccagttgatttctaaagactacctaaaacatcgcagccagctgcttgagcagtcggataaggcattgcctagcgtatctgcaggcgattttattcatgagtgggcgtcctcacaagcgattgagttaccttctaccagtcatatatcaattgtggataaggcgggcaatgtgctatcaatgacgacttccattgaaaatgcgtttggctcaactttgatggcaaatggctacctgctgaataatgagctgacagactttagttttgagccaataaagcagggcaaacaggtcgccaatcgtgtcgagcctggcaagagaccacgctcctcaatggcaccaaccatcgtatttaaagcaggcaagccttatatggcaatcggctctccaggtggtagccgtatcattggctatgtcgctaagacgattgtggcacatagtgactggaatatggatatccaagatgccatcagtgcacccaatttattaaatcgctttggtagctatgaactagaaacgggtacaaccgccgtccagtggcaacaaacattaaatgatttgggctataagactgatgtgcgtgagctaaattcaggtgttcaagccattattatcgagccaagcaggctggttggtggtgtcgatccacgccgagaaggtcgagtgacgggtgat

SEQ ID NO: 5280 - protein, 236 aa, Neisseria gonorrhoeae
LGDPDFVPVPIRQLISKDYLKHRSQLLEQSDKALPSVSAGDFIHEWASSQAIELPSTSHISIVDKAGNVLSMTTSIENAFGSTLMANGYLLNNELTDFSFEPIKQGKQVANRVEPGKRPRSSMAPTIVFKAGKPYMAIGSPGGSRIIGYVAKTIVAHSDWNMDIQDAISAPNLLNRFGSYELETGTTAVQWQQTLNDLGYKTDVRELNSGVQAIIIEPSRLVGGVDPRREGRVTGD

SEQ ID NO: 5281 - DNA, 240 bp, Neisseria gonorrhoeae
atggcggggcaggaagaattgtcttggcaagtggtgtatcagcgggttatggctgataaagatgtggttggtgctggttatttgattgattttgcacaaactgccgaaaatttaccatttgatgtattgcctttgattagccttgtgctaaataaaggtgatgagacgctaaaaaccggcatgttaaataaattacctgataatgccaaagaaaatttacgcattatgggctatctgcct

SEQ ID NO: 5282 - protein, 80 aa, Neisseria gonorrhoeae
MAGQEELSWQVVYQRVMADKDVVGAGYLIDFAQTAENLPFDVLPLISLVLNKGDETLKTGMLNKLPDNAKENLRIMGYLP

SEQ ID NO: 5283 - DNA, 1248 bp, Neisseria gonorrhoeae
atgttttcaaaaagcgttaccctcgcacaatatgaccccgatttggcagcagccattgcccaagaagaccgacgccagcaagaccacgtcgagctgattgcctctgaaaactacgtcagctgcgccgtgatggaggcacaaggttcgcaattgaccaacaaatacgccgaaggctatcccgcaaaacgctactacggcggctgcgaatacgtcgatattgtcgaacaattggcaatcgaccgcgtaaaagaactgtttggcgcagcctatgccaacgttcaaccgcactccggttcccaagccaaccaagccgtatatgcttccgttttaaaaccgggcgacaccattttgggtatgtctctggcgcacggcggacacctgacccacggcgcgagcgttaatatttccggcaaactctacaatgccgttacttatggcttggatgaaaacgaagtcctcgattatgccgaagtcgaacgcctcgcgctcgaacacaaacccaaaatgattgtggcgggcgcgtctgcctacgcgttgcaaatcgactgggcaaaattccgcgaaatcgccgataaagtcggcgcatacctctttgtcgacatggcgcactatgccggactggttgccggcggcgaatatcctaaccccgtgccattctgcgacttcgtaaccactaccacccacaaaaccctacgcggccctcgcggcggtgtgattttgtgccgtgacaatacccacgaaaaagcgctgaactcttccatcttcccaagcctgcaaggcggtccgttgatgcacgttatcgccgccaaagccgtagcgtttaaagaagcgttgcaacccgagttcaaacaatacgcaaaacaagtgaaaatcaatgctgccgtcatggcggaagagttggttaaacgcggtttgcgcatcgtttccggccgcaccgaaagccacgttttcctcgtcgacctgcaaccgatgaaaatcaccggcaaagccgccgaagccgctttgggcaaagcgcacatcaccgtcaacaaaaacgccatcccgaacgatccggaaaaaccgttcgttacctccggcatccgcatcggttccgccgccatgaccactcgcggctttaacgaaaccgacgctcgcgtattgtcgaacttggttgccgatgtattggctaatcccgaagacgaagccaacctcgccaaagtccgcggacaagtgactgccttgtgcgacaaataccccgtttacggaacc

SEQ ID NO: 5284 - protein, 416 aa, Neisseria gonorrhoeae
MFSKSVTLAQYDPDLAAAIAQEDRRQQDHVELIASENYVSCAVMEAQGSQLTNKYAEGYPAKRYYGGCEYVDIVEQLAIDRVKELFGAAYANVQPHSGSQANQAVYASVLKPGDTILGMSLAHGGHLTHGASVNISGKLYNAVTYGLDENEVLDYAEVERLALEHKPKMIVAGASAYALQIDWAKFREIADKVGAYLFVDMAHYAGLVAGGEYPNPVPFCDFVTTTTHKTLRGPRGGVILCRDNTHEKALNSSIFPSLQGGPLMHVIAAKAVAFKEALQPEFKQYAKQVKINAAVMAEELVKRGLRIVSGRTESHVFLVDLQPMKITGKAAEAALGKAHITVNKNAIPNDPEKPFVTSGIRIGSAAMTTRGFNETDARVLSNLVADVLANPEDEANLAKVRGQVTALCDKYPVYGT

SEQ ID NO: 5285 - DNA, 378 bp, Neisseria gonorrhoeae
ttgttttcggtaacattgctattttttctcttccagcaaaatgaccaactttttcaatactgcgatttcactatctttctgcctgatcaattcatcctttgcatccagcagcgacctcaatttttcattttcaaacaccagcatttcatcagagccgataatattatgatggttattggtattgtcgccgatagagaagaaaaacgatcggttctgctccgccagcagctcaaccacatcgatattgaaaatctgggcaatctggcgcagcttgtcgagattgatgccgcttttcccgcgttctattttcgaatacccgttaaccgacatttccaatttttccgccatctcttcctgcgtccactgattgacttccct

SEQ ID NO: 5286 - protein, 126 aa, Neisseria gonorrhoeae
LFSVTLLFFLFQQNDQLFQYCDFTIFLPDQFILCIQQRPQFFIFKHQHFIRADNIMMVIGIVADREEKRSVLLRQQLNHIDIENLGNLAQLVEIDAAFPAFYFRIPVNRHFQFFRHLFLRPLIDFP

SEQ ID NO: 5287 - DNA, 1020 bp, Neisseria gonorrhoeae; identical to SEQ ID NO: 1009

SEQ ID NO: 5288 - protein, 340 aa, Neisseria gonorrhoeae; identical to SEQ ID NO: 1010

SEQ ID NO: 5289 - DNA, 1008 bp, Neisseria gonorrhoeae
aaggctgccgcgcgccatctcgacggcggtctccacggcagttatcaggctgccggagtccgccctgccggttgccgccaaatcgagcgcggtgccgtgatcgacggaggtgcggataaagggcagccccagcgtgatgttcacgccctgcccgaagctgtggtatttcaacacgggcagcccttggtcgtggtacatcgccaatacggcatccgcaccttcgagcataaacggttggaacaatgtgtccgccggatacgggccggcgaggtttatcccttcgcggcgcaggttttcgagcgcggggataatggtgtcggtttcttcgtgtccgaggtgtccgccttcgccggcgtggggattgagcccggcgactaggattttgggatttttgatgccgaatttgtgttttaagtcgtgatgcaaaatgcgtgcgacgctttcaatcagcggttgcgtgatggcggcggcaacgtctttcagcggcaggtgggtcgttacgagggcgacgcgcaggcctttgccggcaagcatcatcacgacctgccccgtgccgcttttttccgccagatattcggtgtgtccgctgaaaaaacctgtgcttgcgcgcgcggcgttgatgatgcctttgtgcagcggcgcggtaacgatgccgtcgaaaatgccgtctgaaatgcctgcgagcgcggcgtccaaaagttgcagcacataggcggcgttggcgggattgagccaccctgcctcaaccgcttcggcggcagggatgtgcagcacttccagcccgccttctccgtgcgcgccgcctgattccggatcgaagtcgcgcaggacgacgcttttgcccaaggcttcggcgcgcgcgcgcaacaggtgtttgtcgcccaataccgcgcagcggcagggcaggcgtgcaaacgccaagtccaaacaaatatcggggccgatgccggcaggctcgccggaagtaacggcaaaaacaggctgtttcatcgtgtttgctccaaacaa

SEQ ID NO: 5290 - protein, 125 aa, Neisseria gonorrhoeae
KAAARHLDGGLHGSYQAAGVRPAGCRQIERGAVIDGGADKGQPQRDVHALPEAVVFQHGQPLVVVHRQYGIRTFEHKRLEQCVRRIRAGEVYPFAAQVFERGDNGVGFFVSEVSAFAGVGIEPGD

SEQ ID NO: 5291 - DNA, 417 bp, Neisseria gonorrhoeae
  MISC_FEATURE (1)..(417): n = g, a, t, or c
atgattgagatgagtaaagattaccgaaacgatttgtacgatgtatatgtttcctacccgccccaagtggatcgcgggcttatccgggagtgccttaaggagaatctcggcgaagaaaaggcggaaggattgatcgaatcgctcgattccaaaccgcaagtgctggttgaggaaaaatgcacttgggcgaaacgggaagagttgcatgattatttcagctatttgggtttggatattattacccgtatatggagttggaaacggtcgtgccgccggaggagggggagggcgaaggaggaggcgcggatggggaaatgcccgaatatcttgaacttcacggcgggcgggaagatgatatttcngtatgttggcaacccgagccgcccggcaatatcaaaccgctggttttcgggttgc

SEQ ID NO: 5292 - protein, 139 aa, Neisseria gonorrhoeae
  MISC_FEATURE (1)..(139): Xaa = any amino acid
MIEMSKDYRNDLYDVYVSYPPQVDRGLIRECLKENLGEEKAEGLIESLDSKPQVLVEEKCTWAKREELHDYFSYLGLDIITRIWSWKRSCRRRRGRAKEEARMGKCPNILNFTAGGKMIFXYVGNPSRPAISNRWFSGC

SEQ ID NO: 5293 - DNA, 399 bp, Neisseria gonorrhoeae
ttggagggcaggatggaagtgcatgacaagattcggacgttaagggaagtcaatcagtggacgcaggaagagatggcggaaaaattggaaatgtcggttaacgggtattcgaaaatagaacgcgggaaaagcggcatcaatctcgacaagctgcgccagattgcccagattttcaatatcgatgtggttgagctgctggcggagcagaaccgatcgtttttcttctctatcggcgacaataccaataaccatcataatattatcggctctgatgaaatgctggtgtttgaaaatgaaaaattgaggtcgctgctggatgcaaaggatgaattgatcaggcagaaagatagtgaaatcgcagtattgaaaaagttggtcattttgctggaagagaaaaaa

SEQ ID NO: 5294 - protein, 133 aa, Neisseria gonorrhoeae
LEGRMEVHDKIRTLREVNQWTQEEMAEKLEMSVNGYSKIERGKSGINLDKLRQIAQIFNIDVVELLAEQNRSFFFSIGDNTNNHHNIIGSDEMLVFENEKLRSLLDAKDELIRQKDSEIAVLKKLVILLEEKK

SEQ ID NO: 5295 - DNA, 345 bp, Neisseria gonorrhoeae
ttgggcaaaaaatataaaaacggttttcatcctgtaaatacgtgtgcggatgtggaagctcggtgggcaaacggagcaatgagagatgttagggacatagaaaggctaataagccgaaacgtccctttacgtcgtatcggagacgccattcaaaacatgtgcatggaaaccaatgtgtccattaggatgtatcgccaggagtgccgttcagaatcgtcagatttttatgacgaaatgcttgagcatcacgagaatttcataggatcctccaaatcattcgcatcatcacttcttccccttagcgttacaaactttacaacagacatggcgtgtactcccgaattt

SEQ ID NO: 5296 - protein, 115 aa, Neisseria gonorrhoeae
LGKKYKNGFHPVNTCADVEARWANGAMRDVRDIERLISRNVPLRRIGDAIQNMCMETNVSIRMYRQECRSESSDFYDEMLEHHENFIGSSKSFASSLLPLSVTNFTTDMACTPEF

SEQ ID NO: 5297 - DNA, 789 bp, Neisseria gonorrhoeae; identical to SEQ ID NO: 283

SEQ ID NO: 5298 - protein, 263 aa, Neisseria gonorrhoeae; identical to SEQ ID NO: 284

SEQ ID NO: 5299 - DNA, 102 bp, Neisseria gonorrhoeae
atgccgtctgaaaagtttcagacggtattagggtctgctacaacatcaaaaaccgcaaaccaaaaggcttgcggttttgtgtctggggcatatcgccgcgat

SEQ ID NO: 5300 - protein, 34 aa, Neisseria gonorrhoeae
MPSEKFQTVLGSATTSKTANQKACGFVSGAYRRD

SEQ ID NO: 5301 - DNA, 642 bp, Neisseria gonorrhoeae
gtgcttgcttctgtgattgattttatcctgcatatcgaccaacacctgctcagcctgtcggcgcaatacggtgtgtggatttatgcgattctgtttttgattgttttttgcgaaaccggtctgattgttacgcccttcctgcccggcgattcgctcttgtttgccgccggcgggattgccgcgctgggcggtatggatattcatttgatggttgcattattaagccttgccgccatactcggcgacgcgctcaattttaccgtcggcaaatatttcggcggcaggctgttcgccaaccccgattctaaaatcttccggtgcgaatacctcggcaaaacccgccgtttttacgaaaaacacggcggcaaaacgattatcatcgcgcgcttcgtgcccatcgtccgcaccttcgcccccttcgtcgccggtatgggaaaaatgcactatgccaaatttatccgctacaacatcatcggcggcttgttgtgggttatcttgttttcttacgcgggctatttctttgccaacttccccgtcgtaaaaaacaatctgggcttggtgatgggcggcatcattattgtttccgtcctgcccggcatcatcgaaatcgcccgcgccaaacttgcggcaaaatccgaacgt

SEQ ID NO: 5302 - protein, 214 aa, Neisseria gonorrhoeae
VLASVIDFILHIDQHLLSLSAQYGVWIYAILFLIVFCETGLIVTPFLPGDSLLFAAGGIAALGGMDIHLMVALLSLAAILGDALNFTVGKYFGGRLFANPDSKIFRCEYLGKTRRFYEKHGGKTIIIARFVPIVRTFAPFVAGMGKMHYAKFIRYNIIGGLLWVILFSYAGYFFANFPVVKNNLGLVMGGIIIVSVLPGIIEIARAKLAAKSER

SEQ ID NO: 5303 - DNA, 1926 bp, Neisseria gonorrhoeae
ttgttggaaattgacattatgaatatattatccgtagaaaacgcttcctttgccgtcggacatgtcgccctgctcgacaaaacgtccttccaactcgacagcggcgaaaaagtcggcttgatcggacgcaacggcgcaggcaagtcttcgtttttaaaaatcctcaccggcgtgcaaaaactcgacgacgggcagattattgttcaaaacaatctcaaaatcgtttatgtgccgcaggagtccttttttgataaggacgcaaccgtatttgatactgttgccgaaggtttgggcgaaattcgcgatttattgcgccgttatcatcatgtcagccatgagttggaaaatggttcgagtgagctcttattgaaagagcttaacgaattgcaacttgaaatcgaagcgaaggacggttggaaactggatgcggcagtcaagcagactttgggggaactcggtttgccggaaaacaaaaaaatcggcaacctttccggcggtcagaaaaaacgcgtcgccttagcgcaggcttgggtacagaagcccgatgtattgttactggacgaaccgaccaaccatttggatatcgacgcgattatttggttggaaaacctgctcaaagcgtttgaaggcagcttggtcgtgattacccacgaccgccgttttttggacaatatcgccacgcgcattgtcgaactcgatcgcggtattttgcgctcctatcccggctcgttctccaaatacagcgagaaaaaagcgcaagagttggcggttgaagccgaacacaaccgcctcttcgacaaattccacgcgcaggaagaggcgtggatacgcaaaggcatcgaagcgcgccgtacccgcaacgaaggccgcgtgcgccgtttggaagaactgcgccgccagcgtgccgaacgccgcaatgtacaaggacaggtcaacttcaaactcgacagcggcaagaaaagcggcaaaatcatcgccgaactggaacacgcttcgtttgcctatgacgacaaagttatcatggataaattttccgccatcttgcagcgcggcgacaaaatcggcttaatcggcccaaacggtatcggcaaaaccaccttccttaagctgattttgggcgaattgcagccgacctacggcagaatccgtatcggcagcaagcaggaagtcgcctatttcgaccagttccgcagcgccttgaatgaaaacgatactgtgttttacacgctcggacagggcaacgattacgtcgaagtcggcggcaagaaaaagcatgtgatgagctatttggaagatttcctgttcccccctgcccgcgcgcaaagtcctgtttcttcactctccggcggcgaacgcaaccgccttttgctggcaaaactctttactcgtcccgccaatattttggttttggacgaaccgaccaacgacttggacatcgacacccaagaattgcttgaagatctgttgcgcgattaccaaggcacggtcttcctcgtctcgcacgaccgtatgttcctcgacaatgtaattacccaaagcattgttttcgaaggacaaggccgtctgaaagaatacatcggcggctatcaggactatatcgacgcaaaatcgcgggaagataaaattcagacggcatccgcacccaaagcatccgatgtcgaacccgccaaagaaaaacccaaagccaaccgtacggtcaaactttcctacaaagaacagcgcgaactcgacgccctgcccgacgaaatcgccgccttggaaaccgaacaggcagaaatcaacgcgcagctttccgatcccggaattttcaaagattacgaaaaagcaggagcattgcaaaaccgcgccgaagaaatcgaaatgctgcttttggaaaagctggaacgctgggagctgctggaaaccaaacagaacggcaatgccgtc

SEQ ID NO: 5304 - protein, 642 aa, Neisseria gonorrhoeae
LLEIDIMNILSVENASFAVGHVALLDKTSFQLDSGEKVGLIGRNGAGKSSFLKILTGVQKLDDGQIIVQNNLKIVYVPQESFFDKDATVFDTVAEGLGEIRDLLRRYHHVSHELENGSSELLLKELNELQLEIEAKDGWKLDAAVKQTLGELGLPENKKIGNLSGGQKKRVALAQAWVQKPDVLLLDEPTNHLDIDAIIWLENLLKAFEGSLVVITHDRRFLDNIATRIVELDRGILRSYPGSFSKYSEKKAQELAVEAEHNRLFDKFHAQEEAWIRKGIEARRTRNEGRVRRLEELRRQRAERRNVQGQVNFKLDSGKKSGKIIAELEHASFAYDDKVIMDKFSAILQRGDKIGLIGPNGIGKTTFLKLILGELQPTYGRIRIGSKQEVAYFDQFRSALNENDTVFYTLGQGNDYVEVGGKKKHVMSYLEDFLFPPARAQSPVSSLSGGERNRLLLAKLFTRPANILVLDEPTNDLDIDTQELLEDLLRDYQGTVFLVSHDRMFLDNVITQSIVFEGQGRLKEYIGGYQDYIDAKSREDKIQTASAPKASDVEPAKEKPKANRTVKLSYKEQRELDALPDEIAALETEQAEINAQLSDPGIFKDYEKAGALQNRAEEIEMLLLEKLERWELLETKQNGNAV

SEQ ID NO: 5305 - DNA, 501 bp, Neisseria gonorrhoeae
ttgcaatgctcctgctttttcgtaatctttgaaaattccgggatcggaaagctgcgcgttgatttctgcctgttcggtttccaaggcggcgatttcgtcgggcagggcgtcgagttcgcgctgttctttgtaggaaagtttgaccgtacggttggctttgggtttttctttggcgggttcgacatcggatgctttgggtgcggatgccgtctgaattttatcttcccgcgattttgcgtcgatatagtcctgatagccgccgatgtattctttcagacggccttgtccttcgaaaacaatgctttgggtaattacattgtcgaggaacatacggtcgtgcgagacgaggaagaccgtgccttggtaatcgcgcaacagatcttcaagcaattcttgggtgtcgatgtccaagtcgttggtcggttcgtccaaaaccaaaatattggcgggacgagtaaagagttttgccagcaaaaggcggttgcgttcgccgccggagag

SEQ ID NO: 5306 - protein, 167 aa, Neisseria gonorrhoeae
LQCSCFFVIFENSGIGKLRVDFCLFGFQGGDFVGQGVEFALFFVGKFDRTVGFGFFFGGFDIGCFGCGCRLNFIFPRFCVDIVLIAADVFFQTALSFENNALGNYIVEEHTVVRDEEDRALVIAQQIFKQFLGVDVQVVGRFVQNQNIGGTSKEFCQQKAVAFAAGE

SEQ ID NO: 5307 - DNA, 393 bp, Neisseria gonorrhoeae
atgccgtccgaacgttcagacggcataacacaaaccagccggtcacacggaaaacgacgatccgcaaccgcaggttgtttccgcattcggattgcggatgacgaactgcgaaccctgcagactttccgtatagtcgatttccgcaccgaccagatattgatagctcatcggatcgaccaaaaagaccaaaccgtttttctcaatttcaaaatcgtcgtcgtttttgatttcgtcaaaagtaaatccgtactggaaacccgaacagccgccgccgttgacaaaaacccgcaatttcaaatcgggattgttttcttcggcaatcaaatcggcaactttggcacagcagctgtcagtaaaaataatagggctttcgtccgacatggtgttattcct

SEQ ID NO: 5308 - protein, 131 aa, Neisseria gonorrhoeae
MPSERSDGITQTSRSHGKRRSATAGCFRIRIADDELRTLQTFRIVDFRTDQILIAHRIDQKDQTVFLNFKIVVVFDFVKSKSVLETRTAAAVDKNPQFQIGIVFFGNQIGNFGTAAVSKNNRAFVRHGVIP

SEQ ID NO: 5309 - DNA, 159 bp, Neisseria gonorrhoeae; identical to SEQ ID NO: 1029

SEQ ID NO: 5310 - protein, 53 aa, Neisseria gonorrhoeae; identical to SEQ ID NO: 1030

SEQ ID NO: 5311 - DNA, 327 bp, Neisseria gonorrhoeae; identical to SEQ ID NO: 285

SEQ ID NO: 5312 - protein, 109 aa, Neisseria gonorrhoeae; identical to SEQ ID NO: 286

SEQ ID NO: 5313 - DNA, 90 bp, Neisseria gonorrhoeae
ttgctgatcatttctgctttcccaaaaggcggtttcggacggcgcggcaacgggcgcgagtataacattttatcggaattgttgacagtc

SEQ ID NO: 5314 - protein, 30 aa, Neisseria gonorrhoeae
LLIISAFPKGGFGRRGNGREYNILSELLTV

SEQ ID NO: 5315 - DNA, 1473 bp, Neisseria gonorrhoeae
atgatcagcaaacaagaataccaagcccaagccgcccaaggctacaaccgcatcccgctcgtgcaagaactccttgccgacttggatacgccgctttccctctatctcaaactcgccaaccgcccctatacctacctgctcgaatccgttgtcggcggcgaacgtttcggccgctattcctttatcggcctgccttgcagccactatctcaaagccggcggcaaacacgtcgatgtttatcaaaacggcgaaatcgtcgaacaatacgacggcaatccgctaccctttatcgaagctttccacaaccgtttcaaaacacccgaaatcccaagcctgccgcgctttaccggcggcttggtcggctacttcggttacgaaaccgtctacaatttcgaacacttcgcccaccgcctgaaaaacaccgccaaagccaacccgctcggcacgcccgatattttgctgatgctgtcgcaagagttggcggtaatcgacaatttgagcggcaaaatccacctcatcgtttatgctgatccctcgcagcccgacagctacgaacgcgcccgcgaacgcctcgaagacatccgcacccagttgcgccaaagctgcgccatcccactttccctcggcagcaaacaaacccaagcagtcagcgagttcggcgaagaacctttcaaagcctgcgtcgataaaatcaaagactacattttcgcaggcgactgtatgcaggtcgtccccagccaacgcatgagcatggaatttaccgacaatccgcttgccctctaccgcgccctgcgcacgctcaacccttcgccttacctcttttactacgatttcggcgatttccacatcgtcggttcctcgcccgaaatcctcgtccgccgcgaacgcgacgacgtcatcgtccgccccatcgccggcacgcgcctgcgcggcaaaacccccgccgaagaccttgccaacgaacaagatttgttaagcgacgccaaagaaatcgccgaacacgttatgcttatcgatttggggcgcaacgatgtcggacgcatcagcaaaacaggcgaagtcaaagtcaccgacaaaatggtgattgaaaaatactcccatgtgatgcacatcgtttccaacgtcgaaggctgtttgaaagagggcgttaccaatatggacatcctcgccgccaccttccctgccggcacactctccggcgcgccaaaagtccgcgcgatggaaatcatcgaagaaatcgaaccggagaaacgcggcatctacggcggcgccgtcggcgtatggggcttcaacaacgatatggatttggcaatcgccatccgcaccgccgtgattaaaaacaataccctcttcatccaaagcggcgcgggcgtggttgccgactccgacccaacttccgaatggcaggaaactcaaaacaaagcccgcgcagtggttcgggcggcgcagatggtgcaggaagggttggataaa

SEQ ID NO: 5316 - protein, 491 aa, Neisseria gonorrhoeae
MISKQEYQAQAAQGYNRIPLVQELLADLDTPLSLYLKLANRPYTYLLESVVGGERFGRYSFIGLPCSHYLKAGGKHVDVYQNGEIVEQYDGNPLPFIEAFHNRFKTPEIPSLPRFTGGLVGYFGYETVYNFEHFAHRLKNTAKANPLGTPDILLMLSQELAVIDNLSGKIHLIVYADPSQPDSYERARERLEDIRTQLRQSCAIPLSLGSKQTQAVSEFGEEPFKACVDKIKDYIFAGDCMQVVPSQRMSMEFTDNPLALYRALRTLNPSPYLFYYDFGDFHIVGSSPEILVRRERDDVIVRPIAGTRLRGKTPAEDLANEQDLLSDAKEIAEHVMLIDLGRNDVGRISKTGEVKVTDKMVIEKYSHVMHIVSNVEGCLKEGVTNMDILAATFPAGTLSGAPKVRAMEIIEEIEPEKRGIYGGAVGVWGFNNDMDLAIAIRTAVIKNNTLFIQSGAGVVADSDPTSEWQETQNKARAVVRAAQMVQEGLDK

SEQ ID NO: 5317 - DNA, 936 bp, Neisseria gonorrhoeae
atgcaattcacatcattagaaatttgtgccggagcaggcggacaggctttgggcttagaaagggcaggcttttcccatgttgcgttaatcgaaatcgaaccgtcggcttgtcaaaccctacgtttaaaccgtcctgattggaacgttattgaaggagatgtccgcttgtttcagggcgaaggatatgacggtattgatttattggccggcggcgtgccttgccctcctttttccaaagctggaaaacaactgggaaaagatgatgaacgcgatttattccctgaggctattcgtctagctaaggaaactgaccctaaagccatcatgttagaaaatgtgcgggggttacttgacccaaaatttgaaaattatcgcaaccatattacagaacaatttgccaagttgggttaccttggacaatggaaactactttatgctgccgattacggagtatcgcaactcagacccagggttttatttgttgcgttgaaaaacgaatacaccaattttttcaaatggcctgaaccaaattcggaacaaccgaaaaccgttggagaactgctttttgacttaatgtcagaaaataactggcagggggcgcataactggcgtttgaaggccgcgcagattgcaccgaccttggtcggcggttcaaaaaaacacggcggtgctgacttggggcctacacgatccaaacgcgcatgggcggagttgggtgtggatggttcaggtttgtgggatagtgcgccgcctgaagacttttcgggaatgcctagattgactgtccgaatgacggcgcgtatccaaggatttcctgatgactggcaattttttggtaaaaaaacgcctatgtaccgccaaatcggcaacgcttttcccccgccggtagccgaagcggtgggcaggcagattatcaaagccttaaaaaaggaaaat

SEQ ID NO: 5318 - protein, 312 aa, Neisseria gonorrhoeae
MQFTSLEICAGAGGQALGLERAGFSHVALIEIEPSACQTLRLNRPDWNVIEGDVRLFQGEGYDGIDLLAGGVPCPPFSKAGKQLGKDDERDLFPEAIRLAKETDPKAIMLENVRGLLDPKFENYRNHITEQFAKLGYLGQWKLLYAADYGVSQLRPRVLFVALKNEYTNFFKWPEPNSEQPKTVGELLFDLMSENNWQGAHNWRLKAAQIAPTLVGGSKKHGGADLGPTRSKRAWAELGVDGSGLWDSAPPEDFSGMPRLTVRMTARIQGFPDDWQFFGKKTPMYRQIGNAFPPPVAEAVGRQIIKALKKEN

SEQ ID NO: 5319 - DNA, 858 bp, Neisseria gonorrhoeae; identical to SEQ ID NO: 195

SEQ ID NO: 5320 - protein, 286 aa, Neisseria gonorrhoeae; identical to SEQ ID NO: 196

SEQ ID NO: 5321 - DNA, 1134 bp, Neisseria gonorrhoeae
atgaacacaccccccatccttcctcccgccatgctcggcatcctcggcggcggacaattaggcagaatgtttgccgttgccgctaaaaccatgggctacaaagtaaccgttctcgatcccgacccgaatgcgccggcggcggaatttgccgaccgccatttgtgcgcgccgtttgacgaccgggccgcgttggacgaattggcaaaatgcgcggcggttacgaccgaatttgaaaacgtcaatgccgacgcgatgcgctctctggcaaagcataccaacgtttcccccagcggcgactgcgtgtccattgcacaaaaccgcattcaggaaaaagcgtggatacgcaaagcaggcttgcaaaccgcgccgtatcaggcggtttgcaaggccgaagacattactgaagcaagcgcgcaatttttgcccggcatcctgaaaacggctacgttgggctacgacggcaaaggtcaaatccgcgtcaaaacgttggacgaactcaaagccgcgtttgccgaacacggcggcgtggattgcgttttggaaaaaatggtggacttgcgcggcgagatttccgtgatcgtatgccgtctgaacgatgaaaacgtgcaaaccttcgaccccgccgaaaacatccacgaaaacggcatcttggcttattccatcgtccccgcgcggctgagtgccgacgtgcagcaacaggcgcggcagacggcgcaacgcttggcggacgaattggattatgtcggcgtattggcggtagaaatgtttgttgtcggcgacacacatgaattgctcgtcaatgaaaccgccccgcgcacgcacaattccggccaccatacgatagatgcctgcgccgcagaccagttccaacagcaggtacgcattatgtgcaacctgccgcccgccgacaccaaattattatccccttgctgtatggcgaatattttgggcgacgtttggcaggaagatggcggcgaaccggattggctgccgttgcaaagccggccgaatgcacacctgcacctatacggaaaaaaaaccgcacagaaaggtcggaaaatgggacactttaccgttttgaccaccgattcggacaccgcatttcaagaagcaaaaaaactgcatcagtcccta

SEQ ID NO: 5322 - protein, 378 aa, Neisseria gonorrhoeae
MNTPPILPPAMLGILGGGQLGRMFAVAAKTMGYKVTVLDPDPNAPAAEFADRHLCAPFDDRAALDELAKCAAVTTEFENVNADAMRSLAKHTNVSPSGDCVSIAQNRIQEKAWIRKAGLQTAPYQAVCKAEDITEASAQFLPGILKTATLGYDGKGQIRVKTLDELKAAFAEHGGVDCVLEKMVDLRGEISVIVCRLNDENVQTFDPAENIHENGILAYSIVPARLSADVQQQARQTAQRLADELDYVGVLAVEMFVVGDTHELLVNETAPRTHNSGHHTIDACAADQFQQQVRIMCNLPPADTKLLSPCCMANILGDVWQEDGGEPDWLPLQSRPNAHLHLYGKKTAQKGRKMGHFTVLTTDSDTAFQEAKKLHQSL

SEQ ID NO: 5323 - DNA, 108 bp, Neisseria gonorrhoeae
ttgaagatgtctttgcagtcttgcacggtggcggggcgtaacagtgtcagcaggctcatggcggtatgtcggcggcttcagacggcatctgtgccgttggtcggatta

SEQ ID NO: 5324 - protein, 36 aa, Neisseria gonorrhoeae
LKMSLQSCTVAGRNSVSRLMAVCRRLQTASVPLVGL

SEQ ID NO: 5325 - DNA, 129 bp, Neisseria gonorrhoeae
tcgtgtttgctccaaacaaaacgcgattctaacgccacaggcgcgcggcgatgtaaatttttctgattttgttgacaatctgctagaatgggcgtttacaaaatttaaaccctgcttgcataccgccat

SEQ ID NO: 5326 - protein, 21 aa, Neisseria gonorrhoeae
SCLLQTKRDSNATGARRCKFF

SEQ ID NO: 5327 - DNA, 336 bp, Neisseria gonorrhoeae
atgtcggacgaaagccctattatttttactgacagctgctgtgccaaagttgccgatttgattgccgaagaaaacaatcccgatttgaaattgcgggtttttgtcaacggcggcggctgttcgggtttccagtacggatttacttttgacgaaatcaaaaacgacgacgattttgaaattgagaaaaacggtttggtctttttggtcgatccgatgagctatcaatatctggtcggtgcggaaatcgactatacggaaagtctgcagggttcgcagttcgtcatccgcaatccgaatgcggaaacaacctgcggttgcggatcgtcgttttccgtg

SEQ ID NO: 5328 - protein, 112 aa, Neisseria gonorrhoeae
MSDESPIIFTDSCCAKVADLIAEENNPDLKLRVFVNGGGCSGFQYGFTFDEIKNDDDFEIEKNGLVFLVDPMSYQYLVGAEIDYTESLQGSQFVIRNPNAETTCGCGSSFSV

SEQ ID NO: 5329 - DNA, 546 bp, Neisseria gonorrhoeae
atcctcctttttcagataggtactcagataaataccctgaataataaagaaaaaaagcatcagcgcagtcgaaccgaacatcttatagttaacccattgcgcttcaaacctagtaaacacaaaccagttggcaatacccataaaaatcagaaaaccgacccacatatatgtcaattttccccatacggcatccggaagctgaatctccctgccgatactcgctttcaagccgtttttacccgcaaggtggctgcccagcaggaataacgccccgcaccagaacaatactgtcggcttccacataatgaagcggctgtcgcccaaaacaatggttgcgccgccgaatacgacaatcagcaccagtccgacccactgcatcgtatccagccttttatgcttccaatacaggaaagccgcctgaaccacgcctgcaaccaaggcaaccgccgcagcggcaatcatatttttggtaacggtataagtagcaaaaaacaagatgacggacaaaaggtcgctgacaaatttcatatccaaatgagaaagcaa

SEQ ID NO: 5330 - protein, 88 aa, Neisseria gonorrhoeae
ILLFQIGTQINTLNNKEKKHQRSRTEHLIVNPLRFKPSKHKPVGNTHKNQKTDPHICQFSPYGIRKLNLPADTRFQAVFTRKVAAQQE

SEQ ID NO: 5331 - DNA, 447 bp, Neisseria gonorrhoeae
gtgcaagactgcaaagacatcttcaaagtccacctgcactccgtccaatacacctgcatcctcagctacaacgaacacgccctaaaagtatgggaaggcttgttaaacacagaaagctacctgccgaccatttccgatcccgacaaagcactttgggttgccgaatacaaaggcaacatacagggatttttccaaatcgactgccaagaagcacaactcgatgcgctttacgtccaccccctgttccacaatctcggactgggcactgccctgctccgtcaggcagaaaccatcgcccacaaatccggtttgagctttctgaaactctacgcatctctcaactccgtcccgttttaccttctcaaccgctacgaatcgctcggttcggcagtattgcagcttgaccccagcatcaaaatcaaatgcgaactgatgcgcaaacacctc

SEQ ID NO: 5332 - protein, 149 aa, Neisseria gonorrhoeae
VQDCKDIFKVHLHSVQYTCILSYNEHALKVWEGLLNTESYLPTISDPDKALWVAEYKGNIQGFFQIDCQEAQLDALYVHPLFHNLGLGTALLRQAETIAHKSGLSFLKLYASLNSVPFYLLNRYESLGSAVLQLDPSIKIKCELMRKHL

SEQ ID NO: 5333 - DNA, 450 bp, Neisseria gonorrhoeae
atgcttgtcctgtcggttggtagatggggcaactttatacggctgtctgcgcttgtggaaataatgtttgatttgaagattatcagttttggttataaggcgggattagaggtgtttgcgcatcagttcgcatttgattttgatgctggggtcaagctgcaatactgccgaaccgagcgattcgtagcggttgagaaggtaaaacgggacggagttgagagatgcgtagagtttcagaaagctcaaaccggatttgtgggcgatggtttctgcctgacggagcagggcagtgcccagtccgagattgtggaacagggggtggacgtaaagcgcatcgagttgtgcttcttggcagtcgatttggaaaaatccctgtatgttgcctttgtattcggcaacccaaagtgctttgtcgggatcggaaatggtcggcaggtagctttctgtgtt

SEQ ID NO: 5334 - protein, 150 aa, Neisseria gonorrhoeae
MLVLSVGRWGNFIRLSALVEIMFDLKIISFGYKAGLEVFAHQFAFDFDAGVKLQYCRTERFVAVEKVKRDGVERCVEFQKAQTGFVGDGFCLTEQGSAQSEIVEQGVDVKRIELCFLAVDLEKSLYVAFVFGNPKCFVGIGNGRQVAFCV

SEQ ID NO: 5335 - DNA, 351 bp, Neisseria gonorrhoeae
atgaaaacctacgcacaggcactctataccgcagccctgctcaccgcctgcagccccgcagccgattcaaaccatccgtccggacaaaatgccccggccaataccgaatccgacggaaaaaacattaccctgctcaatgcctcatacgatgtgacacggtatttttacaaagaatacaaccacttatttatcaaaacataccaatccgaacaccccggcacatccgtcagcatccaacaatcccacggcggcttcagcaaacaggcattatccgtagccaacggccttcaagccgatgtcgtaaccatgaaccaatcttccgacatcgacctgctcgaaaaaaaggactgg

SEQ ID NO: 5336 - protein, 117 aa, Neisseria gonorrhoeae
MKTYAQALYTAALLTACSPAADSNHPSGQNAPANTESDGKNITLLNASYDVTRYFYKEYNHLFIKTYQSEHPGTSVSIQQSHGGFSKQALSVANGLQADVVTMNQSSDIDLLEKKDW

SEQ ID NO: 5337 - DNA, 639 bp, Neisseria gonorrhoeae
atggttttccttgtccgaaaaaacaaccccaaacagatccgcgattggaacgaccttgccaaagacggcgttaacatcgtcatcgccaagacctcgggcaacggacgctacgccttcctcggcgcatacggttacggtctgaaagccaacaacggcaacgagcaggaagcccaaaaactcgtcgcatccatcctcaaaaacacacccgtttttgaaaacggcggacgcgccgccgccaccaccttcacacaacgcaacatcggcgacgtactcatcacttttgaaaacgaagccaactacgtcagcaaaaaactgacccaaggacagtttgaaatcgtctatccgagctacaccatttccgccgaaagccccgttgccgtcgtcaacagcgtcgtcgcgaaaaaaggcacgcaaaaaaccgcccgcgcctatctcgaatacctttggagcgaaccggcgcaagaactcgccgcctcactctacctgcgtccccgcaaccccgaagtattggcacgacacaaagccgacttccccgacttagacaccttccctcccgaagaaaaattcggcggatgggacaacatcatgaaaacctacttcgccgacggcggcgtattcgaccgcctgaccgcacaaaaa

SEQ ID NO: 5338 - protein, 213 aa, Neisseria gonorrhoeae
MVFLVRKNNPKQIRDWNDLAKDGVNIVIAKTSGNGRYAFLGAYGYGLKANNGNEQEAQKLVASILKNTPVFENGGRAAATTFTQRNIGDVLITFENEANYVSKKLTQGQFEIVYPSYTISAESPVAVVNSVVAKKGTQKTARAYLEYLWSEPAQELAASLYLRPRNPEVLARHKADFPDLDTFPPEEKFGGWDNIMKTYFADGGVFDRLTAQK

SEQ ID NO: 5339 - DNA, 201 bp, Neisseria gonorrhoeae
atgaccattatgccgtctgaaccgcctttcagacggcatttcacacatcaaaacagaaaaccgcacccaaaatcatcatcacaagacacaacggcaaaccggatacaaaacccaacaccgccgccaaaatgccgtctgaagccgtcggcgcaaccatccttatctggggcgcgcctcatcaaaggggcgcataactttcct

SEQ ID NO: 5340 - protein, 67 aa, Neisseria gonorrhoeae
MTIMPSEPPFRRHFTHQNRKPHPKSSSQDTTANRIQNPTPPPKCRLKPSAQPSLSGARLIKGAHNFP

SEQ ID NO: 5341 - DNA, 123 bp, Neisseria gonorrhoeae
atgttccgatacgaaccgcaaaatattggttttgtttctgacaggcaaaagcactgtttatttggctgtcaaaagggatggttaaggaaagttatgcgcccctttgatgaggcgcgccccaga

SEQ ID NO: 5342 - protein, 41 aa, Neisseria gonorrhoeae
MFRYEPQNIGFVSDRQKHCLFGCQKGWLRKVMRPFDEARPR

SEQ ID NO: 5343 - DNA, 189 bp, Neisseria gonorrhoeae
atgttttttgaaagtgtgattgtatatcaaaaagaaatgcggcaaccgtcggcagtgttgattgccggaaatgcgggtcggtcgaaccgatatgctcgaacgcctgataaagttttaaaaacctgccttgcgaagcaggttaatggttttgctaatcttgaattgccggaaacgcgaaacacggaaatc

SEQ ID NO: 5344 - protein, 63 aa, Neisseria gonorrhoeae
MFFESVIVYQKEMRQPSAVLIAGNAGRSNRYARTPDKVLKTCLAKQVNGFANLELPETRNTEI

SEQ ID NO: 5345 - DNA, 603 bp, Neisseria gonorrhoeae
atgaataccgacttccaaaagatcctcaaacaactgggcaaacaggccaaaaaagaagcggcagaaaaacaggaagccgaaaaaaacaagcaaaaacaagaacaggatttggatttttcacaagcagtcggacaagtctccccattaaaaaaccggcagcaatattatgcgcagtccgacaaaacccccatcaaagcccgtcccaaagacaaccgcaccgacgaagaaaactacttctacataggcagcacatacaacgacccacccgccagcttctgcaaaaacggacagggaaaaaacgacatccaacgcctgaaaaacggatactatcccgtcgttaccgatgtcgacctgcacggctacacccaagaagaagcacaaaaagtcctcaacgaattcatcgcattcacccaaaaacgcggcgtatgcggcgaaatcatccacggcagcggattaggttccaaaggctacaaacccgttctgaaaaacatgacccgaaactggctgatgcaacaccccgacgtactcgcctacgtcgaaccccgggaaggcaacgacggctgcgtccgcatcctgctcaaacgcaaattaaggcagcaagac

SEQ ID NO: 5346 - protein, 201 aa, Neisseria gonorrhoeae
MNTDFQKILKQLGKQAKKEAAEKQEAEKNKQKQEQDLDFSQAVGQVSPLKNRQQYYAQSDKTPIKARPKDNRTDEENYFYIGSTYNDPPASFCKNGQGKNDIQRLKNGYYPVVTDVDLHGYTQEEAQKVLNEFIAFTQKRGVCGEIIHGSGLGSKGYKPVLKNMTRNWLMQHPDVLAYVEPREGNDGCVRILLKRKLRQQD

SEQ ID NO: 5347 - DNA, 96 bp, Neisseria gonorrhoeae
ttgagttttcgcaatttatggggtaacttttggggtaacttttcaggaatcaccctaaaaaatatcttaaaaatacaaaagccatcacgcattttt

SEQ ID NO: 5348 - protein, 32 aa, Neisseria gonorrhoeae
LSFRNLWGNFWGNFSGITLKNILKIQKPSRIF

SEQ ID NO: 5349 - DNA, 522 bp, Neisseria gonorrhoeae
ttgcaggcgtttgaccaacagattttcattaatccgcaacacatacagtccgtctctcggcgtattttccccatgattgaccaaaatcgaatctccgtcattcaaaaccccctccatcgaatcccccttgacggaaattacagacaggtttttcgtatctcgggtaacataattctcaatccaatgccgtctgaacgccattgtaaataccggttcctcatgaccgacaaactgcccgtatcccgcagccgcccgaatatcatatctcggcacaaagacaaactcgtccgtatcaacttcatttcccaaggtatcgtaagcaagggatttttttggggcttcatccggaaacggattaccctcccctgtcagcagccaatcgatactacaccccttcaactgcttaatttttttcaatgtttcagacttcggcagaccgccttcattccatattctgctgaagcccgcaatcgtcatttcaatatcggatgcgatttttgcctgcctcgcttcacttttcca

SEQ ID NO: 5350 - protein, 174 aa, Neisseria gonorrhoeae
LQAFDQQIFINPQHIQSVSRRIFPMIDQNRISVIQNPLHRIPLDGNYRQVFRISGNIILNPMPSERHCKYRFLMTDKLPVSRSRPNIISRHKDKLVRINFISQGIVSKGFFWGFIRKRITLPCQQPIDTTPLQLLNFFQCFRLRQTAFIPYSAEARNRHFNIGCDFCLPRFTFP

SEQ ID NO: 5351 - DNA, 111 bp, Neisseria gonorrhoeae; identical to SEQ ID NO: 1093

SEQ ID NO: 5352 - protein, 37 aa, Neisseria gonorrhoeae; identical to SEQ ID NO: 1094

SEQ ID NO: 5353 - DNA, 129 bp, Neisseria gonorrhoeae
tacttggtttatatgcttttgggtacggggcttttcttcaccgtaaccacgggctttgtccaattccgcctgttcgggcgcagcatcaaagaaatgctcggcggccgcaaacagggggacgaccctcac

SEQ ID NO: 5354 - protein, 43 aa, Neisseria gonorrhoeae
YLVYMLLGTGLFFTVTTGFVQFRLFGRSIKEMLGGRKQGDDPH

SEQ ID NO: 5355 - DNA, 96 bp, Neisseria gonorrhoeae
ttgattaaactgtccgactttttggggtgcagttcagcttcggcattttttatccgtttgggggtaacttgtttggaaagctgcaagccttataaa

SEQ ID NO: 5356 - protein, 32 aa, Neisseria gonorrhoeae
LIKLSDFLGCSSASAFFIRLGVTCLESCKPYK

SEQ ID NO: 5357 - DNA, 819 bp, Neisseria gonorrhoeae
atgccatccgttgaactgctgttggggattgtcggactgccacgcagcaccttctattaccaattggccgtccaatcggcagaaggcaaatatgccgatttgaaacgacatatccatgatatttatcaacgatataagggaagatacggctaccggaggattgcggcagccatccgtcacgcaggaataccggtcaatcacaagaaagtcagccgtctgatggcgaagacggggctgaaggcagtgatacggcggcgcaaataccgctcgttcaaaggagaagtcggcaaagttgcgccgaacatcctgcaacgctgtttccattcagaaaagccgaatgagaaatgggtaacggacgttaccaagttcgatgtaggcggagaaaagatatacctttctccgattatggatttgtttaacggggaaatcgtcagttaccgtattcaaacccgcccgactttcgatttggccggcgagatactgaaaggtgcgccggagaaaccggggccgtctgaaaagccgatgctgcattcggatcaaggttggcaatatcagatgtttttttatcaaaagcagttgaaaggcaacggtctggttcagagtctgtcccgcaagggaaactgcttggacaatgcggcaatggaaagtttcttcggaacgttgaaatcggaatgtttccatacgtgcaaatatgattccgttaccgaatcggaagcggcactgcacgaatatatccgttactacaacaacgatagaatcaagttgaaattaaaaggactgagccctgttcagtacagaattcagtccctgaaagccgct

SEQ ID NO: 5358 - protein, 273 aa, Neisseria gonorrhoeae
MPSVELLLGIVGLPRSTFYYQLAVQSAEGKYADLKRHIHDIYQRYKGRYGYRRIAAAIRHAGIPVNHKKVSRLMAKTGLKAVIRRRKYRSFKGEVGKVAPNILQRCFHSEKPNEKWVTDVTKFDVGGEKIYLSPIMDLFNGEIVSYRIQTRPTFDLAGEILKGAPEKPGPSEKPMLHSDQGWQYQMFFYQKQLKGNGLVQSLSRKGNCLDNAAMESFFGTLKSECFHTCKYDSVTESEAALHEYIRYYNNDRIKLKLKGLSPVQYRIQSLKAA

SEQ ID NO: 5359 - DNA, 303 bp, Neisseria gonorrhoeae
gtgacggggcagggaatgtcccaaaaagctgccgcagaccaactgaatctgcccgactgctccgttttgccgcaatggttgcgcctctaccgtttgaatggtattaacggtttaaagcccaaacccaaaggaagaaagcccgtgaaaaaacagtatccgccgcaaacgaaaaaagccgactatctgaaaaccaaggaagaactgtttgcggaattggcttaccttaaagcggaagcggctgtcctaaaaaagctcgatgccttgaaagaagtgcggcagaaagaacgcaactcgtcgcagggt

SEQ ID NO: 5360 - protein, 101 aa, Neisseria gonorrhoeae
VTGQGMSQKAAADQLNLPDCSVLPQWLRLYRLNGINGLKPKPKGRKPVKKQYPPQTKKADYLKTKEELFAELAYLKAEAAVLKKLDALKEVRQKERNSSQG

SEQ ID NO: 5361 - DNA, 324 bp, Neisseria gonorrhoeae
atgccgctttcaccgtgtaatctgtatcttgccacccatttgcgtaccaatgaatcggaaatggaaaaatatagtgaattaacaaaaatcaggacaaggcggcggaccgcaggcagtacgaatggtacggaaccggttcgcccggcgctccatcaccttagggaatcgttccctttgggccggggcggggcaacgccgtaccggtttttgttaatccgctatattacggacaatgcaaaaacaccggccaaaccgcagcaacgtttaacttgtcaagaaacacgctttacctgcggattcgccttaaaaaacaaacaggcagcc

SEQ ID NO: 5362 - protein, 108 aa, Neisseria gonorrhoeae
MPLSPCNLYLATHLRTNESEMEKYSELTKIRTRRRTAGSTNGTEPVRPALHHLRESFPLGRGGATPYRFLLIRYITDNAKTPAKPQQRLTCQETRFTCGFALKNKQAA

SEQ ID NO: 5363 - DNA, 405 bp, Neisseria gonorrhoeae
atgccgccaaatcggataggcaaaaaccggctcgatatgtcgggcggcatccggatgcctgtctgcatgaaatcgccaaacattttgattgtacggcagccgccgtttgccatgcgcccaaacagatgcggatggcgcgcaaaaaagaccgccgcttacaaaggacaagacccggccaaagtaacgcattatttgacacggccggccggattttccgactgccaacgcgtttgtccggatgaaacaggattcgaccgccgcctgttccgcccctatgcccgcagcctgaaagggcaaatggcgaaagcgcggataagtgggaaaagataccggcgcttatctgcggaacacgccgagggattttccaaggggtgcggctgccgctatatcacgaaatccaacagg

SEQ ID NO: 5364 - protein, 135 aa, Neisseria gonorrhoeae
MPPNRIGKNRLDMSGGIRMPVCMKSPNILIVRQPPFAMRPNRCGWRAKKTAAYKGQDPAKVTHYLTRPAGFSDCQRVCPDETGFDRRLFRPYARSLKGQMAKARISGKRYRRLSAEHAEGFSKGCGCRYITKSNR

SEQ ID NO: 5365 - DNA, 249 bp, Neisseria gonorrhoeae
gtgcggctgccgctatatcacgaaatccaacaggtagaaatcttctttgcccacgccgcattcggggcatttccagtcgtcggggatgtcttcaaactttgtcccgggggcgatgccgtgttccgggtcgccgagttcttcatcgtaaatccagccgcaggggccgcacatatattgagccatttgtgtttccttgtttgtaccgtgcttttttgcagcgggccgccggggtttggttcggatgccgtc

SEQ ID NO: 5366 - protein, 83 aa, Neisseria gonorrhoeae
VRLPLYHEIQQVEIFFAHAAFGAFPVVGDVFKLCPGGDAVFRVAEFFIVNPAAGAAHILSHLCFLVCTVLFCSGPPGFGSDAV

SEQ ID NO: 5367 - DNA, 708 bp, Neisseria gonorrhoeae
atgaaggggagcggaaggatatttatggaaacctttaaagacagactggtttttttatggaaaagtgaagcgaggcaggcaaaaatcgcatccgatattgaaatgacgattgcgggcttcagcagaatatggaatgaaggcggtctgccgaagtctgaaacattgaaaaaaattaagcagttgaaggggtgtagtatcgattggctgctgacaggggagggtaatccgtttccggatgaagccccaaaaaaatcccttgcttacgataccttgggaaatgaagttgatacggacgagtttgtctttgtgccgagatatgatattcgggcggctgcgggatacgggcagtttgtcggtcatgaggaaccggtatttacaatggcgttcagacggcattggattgagaattatgttacccgagatacgaaaaacctgtctgtaatttccgtcaagggggattcgatggagggggttttgaatgacggagattcgattttggtcaatcatggggaaaatacgccgagagacggactgtatgtgttgcggattaatgaaaatctgttggtcaaacgcctgcaaatcgtccccggcgggattatcaatgtcatttccgccaacgaggcttatcctgcttttgaaatcaatttgaacgacttgaccgatgatgtggagattatcgggcgtgtcgagtggttcggcaggacggtt

SEQ ID NO: 5368 - protein, 236 aa, Neisseria gonorrhoeae
MKGSGRIFMETFKDRLVFLWKSEARQAKIASDIEMTIAGFSRIWNEGGLPKSETLKKIKQLKGCSIDWLLTGEGNPFPDEAPKKSLAYDTLGNEVDTDEFVFVPRYDIRAAAGYGQFVGHEEPVFTMAFRRHWIENYVTRDTKNLSVISVKGDSMEGVLNDGDSILVNHGENTPRDGLYVLRINENLLVKRLQIVPGGIINVISANEAYPAFEINLNDLTDDVEIIGRVEWFGRTV

SEQ ID NO: 5369 - DNA, 327 bp, Neisseria gonorrhoeae
ttgcagggtgaagcgttcgctttttggacaggcgtagccgcagcatttttctcccagataacgtttaacttggacacgctccaaaccgccacggaaacgtgtggattcgccgcccggttgggtgtaggtataaccggcatacacggcagccattttgcctattgcgccgttagcgatgtgtgcattccctcttttgtcgtctgcatcgtttttgcttcgggcgtactctgccttaaaacgcatatcgtggcgttcgttgaacgaaaaccgatggacggtgtgcgttatttttctttcaaattgccggcagtggctttgcctttaaca

SEQ ID NO: 5370 - protein, 109 aa, Neisseria gonorrhoeae
LQGEAFAFWTGVAAAFFSQITFNLDTLQTATETCGFAARLGVGITGIHGSHFAYCAVSDVCIPSFVVCIVFASGVLCLKTHIVAFVERKPMDGVRYFSFKLPAVALPLT

SEQ ID NO: 5371 - DNA, 252 bp, Neisseria gonorrhoeae
atgcggcggcccgcttcagacggcatccgaaccaaaccccggcggcccgctgcaaaaaagcacggtacaaacaaggaaacacaaatggctcaatatatgtgcggcccctgcggctggatttacgatgaagaactcggcgacccggaacacggcatcgcccccgggacaaagtttgaagacatccccgacgactggaaatgccccgaatgcggcgtgggcaaagaagatttctacctgttggatttcgtgata

SEQ ID NO: 5372 - protein, 84 aa, Neisseria gonorrhoeae
MRRPASDGIRTKPRRPAAKKHGTNKETQMAQYMCGPCGWIYDEELGDPEHGIAPGTKFEDIPDDWKCPECGVGKEDFYLLDFVI

SEQ ID NO: 5373 - DNA, 414 bp, Neisseria gonorrhoeae
gtgggaaaagataccggcgcttatctgcggaacacgccgagggattttccaaggggtgcggctgccgctatatcacgaaatccaacaggtagaaatcttctttgcccacgccgcattcggggcatttccagtcgtcggggatgtcttcaaactttgtcccgggggcgatgccgtgttccgggtcgccgagttcttcatcgtaaatccagccgcaggggccgcacatatattgagccatttgtgtttccttgtttgtaccgtgcttttttgcagcgggccgccggggtttggttcggatgccgtctgaagcgggccgccgcatctgtcccgccttgggcggtttgtgcttcagacggcattttccgcctgtttattttgcggcttcgattgctgctatttctttgcagaggtgtt

SEQ ID NO: 5374 - protein, 138 aa, Neisseria gonorrhoeae
VGKDTGAYLRNTPRDFPRGAAAAISRNPTGRNLLCPRRIRGISSRRGCLQTLSRGRCRVPGRRVLHRKSSRRGRTYIEPFVFPCLYRAFLQRAAGVWFGCRLKRAAASVPPWAVCASDGIFRLFILRLRLLLFLCRGV

SEQ ID NO: 5375 - DNA, 1080 bp, Neisseria gonorrhoeae
atgaacgcccaaaccctgcttgccaacgttgccgaactcgtcaaaaccaagctcaaacccctcgtcgacgacatcgaccgcaaaggatactaccccgaagcatttatgcgcgaactcggcgcaatcggcgcagtcggtatagaagccgaaggcggcaacggcttaggcttggcaacacgaatcgccgtcttgcgcgaaatcggcaaagaatgcggcgcgacctccttcagcgcgtggtgtcaggcggcttgcgcgtggtatctgcaccaaacgcccaaccaagccgtcaaagacaaatacctcgccgacatcctgcaaggcaaagtattggcgggcaccggaatgtccaataccgtcaaacaccttgccggcattgaaaaacacaaccttcaagccgagtgcgtggagggcggttatacagtcaacggtgcgctgccgtgggtgtccaacatcggcgaagaccacatttgggcgaataccgcccaaatcggcggcggctacgtcatgttcatcacaggcgggcaaagggaaggcgtaagcctgcaaaactgccccgaattttgcgccctcgaaggcacgcacaccttcagcctgaatttcaaagacgtatttattcccgacgaagacatcatcgctgcgcccgaacagtttgccggctacatccaaagcatcaaagcaggcttcatcctcctgcaaatcggtatcggcgcgggcgtgattgacggcagcctcggcatcatccgcctcgtcaacgtcgtcaacgccgaagtcaacagctatctcgacgacggctacgacagcctcaaagcaaggctggacggcgcgtgggcagaaaccgaacggctcgccggattggcgtgggacaacacgcccgacaacctcgccaccctcaagctgcgcgaagccgccgccgtactggcccttgccgctgcgcaatccgccgccctgcattccggcgcgaaaggctacctgatgcggagtcccgcccaaaggcgcgtcggcgaagcgatgtttgtcgccatcgtaacccccgcaatcaaacacctctgcaaagaaatagcagcaatcgaagccgcaaaa

SEQ ID NO: 5376 - protein, 360 aa, Neisseria gonorrhoeae
MNAQTLLANVAELVKTKLKPLVDDIDRKGYYPEAFMRELGAIGAVGIEAEGGNGLGLATRIAVLREIGKECGATSFSAWCQAACAWYLHQTPNQAVKDKYLADILQGKVLAGTGMSNTVKHLAGIEKHNLQAECVEGGYTVNGALPWVSNIGEDHIWANTAQIGGGYVMFITGGQREGVSLQNCPEFCALEGTHTFSLNFKDVFIPDEDIIAAPEQFAGYIQSIKAGFILLQIGIGAGVIDGSLGIIRLVNVVNAEVNSYLDDGYDSLKARLDGAWAETERLAGLAWDNTPDNLATLKLREAAAVLALAAAQSAALHSGAKGYLMRSPAQRRVGEAMFVAIVTPAIKHLCKEIAAIEAAK

SEQ ID NO: 5377 - DNA, 672 bp, Neisseria gonorrhoeae
ttgttccttaaggtttttggggggaaatcgggggcacgcctgatgcgcggctgcttttcccgccgcttgggcggcttgtttttgtttgagggggtgtttttgaaaaaccgcctgcattcaggcggttttgtttgcttaggcgtatgcctgcaatttggggttgatttcggtttgggcgaggttgttggcgtagttgcacaaagttgccaaggctacgcccattacgacttcgactgcctgctgccggttgtagcccgcttcgaggaaggcgttgagttcgtcgtcggatactgcgccttttttcgccattacggcttgggtgaaggcggcaagcgcgccgagtttggcatcgtcagatttacctgccgccaaagcgcgggcggcattgagggattgctcggacaggagttttttcagggttgcgagtttggtgtgccctgccacgcagaagctgcattggttggtgcggacggcgatgatccggatcacttcgacttcgccggcggtcaggctgttggcggcgttgagcttgccgacttcttggtaaaacgccaaagcttcgggggcgtttgccaatacgccgatgaggttggggataaagccgttgtttttgggtacggcctctacgcgcggtttggcggcttcgggggcggtttcgagggtgtgtacggt

SEQ ID NO: 5378 - protein, 224 aa, Neisseria gonorrhoeae
LFLKVFGGKSGARLMRGCFSRRLGGLFLFEGVFLKNRLHSGGFVCLGVCLQFGVDFGLGEVVGVVAQSCQGYAHYDFDCLLPVVARFEEGVEFVVGYCAFFRHYGLGEGGKRAEFGIVRFTCRQSAGGIEGLLGQEFFQGCEFGVPCHAEAALVGADGDDPDHFDFAGGQAVGGVELADFLVKRQSFGGVCQYADEVGDKAVVFGYGLYARFGGFGGGFEGVYG

SEQ ID NO: 5379 - DNA, 546 bp, Neisseria gonorrhoeae
atggcacgtttaaccgtacacaccctcgaaaccgcccccgaagccgccaaaccgcgcgtagaggccgtacccaaaaacaacggctttatccccaacctcatcggcgtattggcaaacgcccccgaagctttggcgttttaccaagaagtcggcaagctcaacgccgccaacagcctgaccgccggcgaagtcgaagtgatccggatcatcgccgtccgcaccaaccaatgcagcttctgcgtggcagggcacaccaaactcgcaaccctgaaaaaactcctgtccgagcaatccctcaatgccgcccgcgctttggcggcaggtaaatctgacgatgccaaactcggcgcgcttgccgccttcacccaagccgtaatggcgaaaaaaggcgcagtatccgacgacgaactcaacgccttcctcgaagcgggctacaaccggcagcaggcagtcgaagtcgtaatgggcgtagccttggcaactttgtgcaactacgccaacaacctcgcccaaaccgaaatcaaccccaaattgcaggcatacgcc

SEQ ID NO: 5380 - protein, 182 aa, Neisseria gonorrhoeae
MARLTVHTLETAPEAAKPRVEAVPKNNGFIPNLIGVLANAPEALAFYQEVGKLNAANSLTAGEVEVIRIIAVRTNQCSFCVAGHTKLATLKKLLSEQSLNAARALAAGKSDDAKLGALAAFTQAVMAKKGAVSDDELNAFLEAGYNRQQAVEVVMGVALATLCNYANNLAQTEINPKLQAYA

SEQ ID NO: 5381 - DNA, 1425 bp, Neisseria gonorrhoeae
atgaacgagaactttaccgaatggctgcacggctgggtcggcgccatcaacgatccgatgtggtcatacttggtttatatgcttttgggtacggggcttttcttcaccgtaaccacgggctttgtccaattccgcctgttcgggcgcagcatcaaagaaatgctcggcggccgcaaacagggggacgaccctcacggcatcacgccgtttcaggcatttgtaaccggccttgccagccgcgtgggcgtgggcaatatcgcgggcgtggcaatcgccatcaaagtcggcgggccgggcgcggtgttttggatgtgggtaaccgccttaatcggcatgagttcggcgtttgtcgaatcttcgctggcgcagctctttaaagtccgcgactgcgacaaccaccatttccggggcggccctgcctactacatcacgcacggtctggggcagaaatggctgggcgtgttgttcgccctgagcctgattttctgtttcggttttgtgtttgaagcggttcagaccaataccatcgccgataccgtcaaagcggcgtggggctgggagcctcattatgtcggcgtcgccctggtgattttaaccgcgccgattatcttcggcggcatcaggcgcatatccaaagcggcggaaatcgtcgtgcccctgatggcggttttgtacctctttatcgcgcttttcatcattttgaccaatattccgatgattccggacgtgttcggtcagattttttcgggcgcgttcaaattcgacgcggcagcaggcggcttactcggcggtctgatttcgcaaacgatgatgatgggcatcaaacgcggcctgtattccaacgaggcgggtatgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttatggcgatttgagcggtgcggcgctgacgcaggcggcgattgtcagccaagtggggcaatggggcgcgggtttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcatcatggcgtggatcaacctcgtcgccatcctgctgctctcgccattggcgtttatgctgctgcgcgattacaccgccaagctgaaaatgggcaaagaccccgagttcaaactttccgaacatccgggcctgaaacgccgcatcaaatccgatgtttgg

SEQ ID NO: 5382 - protein, 475 aa, Neisseria gonorrhoeae
MNENFTEWLHGWVGAINDPMWSYLVYMLLGTGLFFTVTTGFVQFRLFGRSIKEMLGGRKQGDDPHGITPFQAFVTGLASRVGVGNIAGVAIAIKVGGPGAVFWMWVTALIGMSSAFVESSLAQLFKVRDCDNHHFRGGPAYYITHGLGQKWLGVLFALSLIFCFGFVFEAVQTNTIADTVKAAWGWEPHYVGVALVILTAPIIFGGIRRISKAAEIVVPLMAVLYLFIALFIILTNIPMIPDVFGQIFSGAFKFDAAAGGLLGGLISQTMMMGIKRGLYSNEAGMGSAPNAAAAAEVKHPVSQGMIQMLGVFVDTIIVCSCTAFIILIYQQPYGDLSGAALTQAAIVSQVGQWGAGFLAVILFMFAFSTVIGNYAYAESNVQFIKSHWLITAVFRMLVLAWVYFGAVANVPLVWDMADMAMGIMAWINLVAILLLSPLAFMLLRDYTAKLKMGKDPEFKLSEHPGLKRRIKSDVW

SEQ ID NO: 5383 - DNA, 294 bp, Neisseria gonorrhoeae
atgcgttttaaggcagagtacgcccgaagcaaaaacgatgcagacgacaaaagagggaatgcacacatcgctaacggcgcaataggcaaaatggctgccgtgtatgccggttatacctacacccaaccgggcggcgaatccacacgtttccgtggcggtttggagcgtgtccaagttaaacgttatctgggagaaaaatgctgcggctacgcctgtccaaaaagcgaacgcttcaccctgcaagcagatggtgaaatccgtcaaaaccttggcgaaggctggtttctgaagcta

SEQ ID NO: 5384 - protein, 98 aa, Neisseria gonorrhoeae
MRFKAEYARSKNDADDKRGNAHIANGAIGKMAAVYAGYTYTQPGGESTRFRGGLERVQVKRYLGEKCCGYACPKSERFTLQADGEIRQNLGEGWFLKL

SEQ ID NO: 5385 - DNA, 168 bp, Neisseria gonorrhoeae
ttgctggttttcttcatttttctatcctttttctgtcaattcgggattaaacctatggaaaatctgaaaaattatgtattggataagaaaaatcataatttaaatttagtttatcatagttattccgtttttgggatagctaatgtaaaatatatttcatgtttactt

SEQ ID NO: 5386 - protein, 56 aa, Neisseria gonorrhoeae
LLVFFIFLSFFCQFGIKPMENLKNYVLDKKNHNLNLVYHSYSVFGIANVKYISCLL

SEQ ID NO: 5387 - DNA, 291 bp, Neisseria gonorrhoeae
ttgttcggcacgctgtgggcgtgtttcaaaagaatgtggggtttggggctggggatgacgggcgcgatgttcgtgttggcggtgtttgcccaactggtttacggcgacacgcccgccacagactcggcgtttaacgtattgggtttggcggtttccgtctggttcggcgcaaagggcaacagcctttatgcacgccaccttttatcgcgcggctataccgaattgcccgaaacagtcgaagccgccaacccccaagccgcattggcgcaatatttcgggcgcgggggcggg

SEQ ID NO: 5388 - protein, 97 aa, Neisseria gonorrhoeae
LFGTLWACFKRMWGLGLGMTGAMFVLAVFAQLVYGDTPATDSAFNVLGLAVSVWFGAKGNSLYARHLLSRGYTELPETVEAANPQAALAQYFGRGGG

SEQ ID NO: 5389 - DNA, 189 bp, Neisseria gonorrhoeae
ttgtttgacggcttggggcggcagggcgggatgggtgtagattttgtatggtttcatcgtgtttccttttcggttgaaaccctgccctttgggaaggtaggatcagactttatttgtgagacgcgcgcccgtgtgcagacatacggcttgaacatgcccgtcggggaagacagatccgacaatgccgtc

SEQ ID NO: 5390 - protein, 63 aa, Neisseria gonorrhoeae
LFDGLGRQGGMGVDFVWFHRVSFSVETLPFGKVGSDFICETRARVQTYGLNMPVGEDRSDNAV

SEQ ID NO: 5391 - DNA, 1569 bp, Neisseria gonorrhoeae
ttggcggtggtgcgcccgggaagcattttggaaatgtggaaaattctgcaggcctgcgtcgaagcggacgtgattgtgattacgcaggcggcgaataccggactgaccggcggctcgacccccgacggcaacgattacgaccgcgacatcgtgattgtgaacaccatgcggatgaacatcatccaaaccatcaacaacaacgaacaagtcgtctgcctgcccggctcgaccctgaaccagcttgaactgctgctgaaacctttgggacgagaaccgcattcggtcatcggctcttcttgcatcggcgcgtccgttttaggcggcgtgtgcaacaactccggcggcgcgttggtacagcgcggcccggcctacaccgaaatggcgttgttcgcccaaatcaacgaagagggcaggttggaactggtcaaccacttgggcatagacttgggcgacacgcccgaagaaatcctgaccaacctgcaaggtcatcattatcagaaaaaagacatcaagcaagacgcgggcaaaggacatgaccacgcctattgcgaacacgtccgccaagtggacgaaccgaccgccgcgcgtttcaatgccgaccccgcccgccattacgaagcctcgggctgcgcgggcaagctgatggtttttgccgtccgtttggacaccttcccgcaagaaaaacaaaccgccgtgttctacatcggcacgaacgacatcaacgagctgaccgacatccgccgcgccgccttgggcgaatttgaaagcctgcccgtttccggcgaatacatccaccgccacgctttcgacattgccgacgtgtacggcaaagacacgttctacgtcatcaaaaaattcggtacgcaccaactgccgaaattatttgacttgaaggcgcgcgtggacaggttcggcaaaaaagtcagcttcctgcccaaacatttttccgacaaggcaatgcagttcgtcagcaaattcctgcccgaccacctgcccaaatccatgcgcgattaccgcgacaaatacgaacaccacctgattctgaaaatgggcggaaaaggcgtggatgaggcgcgcgcgttcttaaaagaatatttttcacaccacggcggcgcgtttttcgagtgcaacgccgaagaaacccaagccgcgatgctgcaccgtttcgccgtcgcttccgccgccatccgctaccgttccgtgcacgacgacgaagtggaggacttggtcgcgctggatatcgccctgcgccgcgacgaccgcgactggtttgaaaaactgccgccggaaatcgacaataaaatcatccataaattgtattacgggcattttatgtgccacgttttccatcaggattacatcatcaaaaaaggcaacggctgtatggcgttggaacacgaaatgctacatctcttagaccaacgcggcgcgcaatatcccgccgaacacaacgtcggccatttgtatgaagccaagcccgcgctcaaacagttttaccgcaaactcgacccgaccaacagcttcaacccgggtatcggcaaaaccagcaaaaagaaaaactgggcggaa

SEQ ID NO: 5392 - protein, 523 aa, Neisseria gonorrhoeae
LAVVRPGSILEMWKILQACVEADVIVITQAANTGLTGGSTPDGNDYDRDIVIVNTMRMNIIQTINNNEQVVCLPGSTLNQLELLLKPLGREPHSVIGSSCIGASVLGGVCNNSGGALVQRGPAYTEMALFAQINEEGRLELVNHLGIDLGDTPEEILTNLQGHHYQKKDIKQDAGKGHDHAYCEHVRQVDEPTAARFNADPARHYEASGCAGKLMVFAVRLDTFPQEKQTAVFYIGTNDINELTDIRRAALGEFESLPVSGEYIHRHAFDIADVYGKDTFYVIKKFGTHQLPKLFDLKARVDRFGKKVSFLPKHFSDKAMQFVSKFLPDHLPKSMRDYRDKYEHHLILKMGGKGVDEARAFLKEYFSHHGGAFFECNAEETQAAMLHRFAVASAAIRYRSVHDDEVEDLVALDIALRRDDRDWFEKLPPEIDNKIIHKLYYGHFMCHVFHQDYIIKKGNGCMALEHEMLHLLDQRGAQYPAEHNVGHLYEAKPALKQFYRKLDPTNSFNPGIGKTSKKKNWAE

SEQ ID NO: 5393 - DNA, 174 bp, Neisseria gonorrhoeae
atgatgtatttttcgcctacggtttgggtcaggctgctgattaattgcgaggcgttcataacactctcctatcgggataagcggcggcgcaaatcccggtacgccgccgtatgttcaatttggatattttggtgcggcaagttgcacgctgcaaattatttttggttaaagaaa

SEQ ID NO: 5394 - protein, 58 aa, Neisseria gonorrhoeae
MMYFSPTVWVRLLINCEAFITLSYRDKRRRKSRYAAVCSIWIFWCGKLHAANYFWLKK

SEQ ID NO: 5395 - DNA, 417 bp, Neisseria gonorrhoeae; identical to SEQ ID NO: 139

SEQ ID NO: 5396 - protein, 139 aa, Neisseria gonorrhoeae; identical to SEQ ID NO: 140

SEQ ID NO: 5397 - DNA, 102 bp, Neisseria gonorrhoeae
ttgaaattgaaccatacttccatttttatgaagccggttcttcattggcctgtatggatacattgtaatgatgcgttatggcaaagtaaaggaaatgccgtc

SEQ ID NO: 5398 - protein, 34 aa, Neisseria gonorrhoeae
LKLNHTSIFMKPVLHWPVWIHCNDALWQSKGNAV

SEQ ID NO: 5399 - DNA, 270 bp, Neisseria gonorrhoeae
atgaagaaaaccagcaaatatcttatctatactgcggcatttacctcattctgctttgccttccaagaaaaccgttctgaagccaaacagcccgacatcactttatccgcatccctgtgcgaacaattcaacatgctgaacgccaaagatatggatacagaacaagtctccctttccaaagaatgcgacatcatcgagtcttcacacgactgggaaaaagagtacggcaacttgaacgaacaggaaatgctcgccggcgtcgtctatgaa

SEQ ID NO: 5400 - protein, 90 aa, Neisseria gonorrhoeae
MKKTSKYLIYTAAFTSFCFAFQENRSEAKQPDITLSASLCEQFNMLNAKDMDTEQVSLSKECDIIESSHDWEKEYGNLNEQEMLAGVVYE

SEQ ID NO: 5401 - DNA, 237 bp, Neisseria gonorrhoeae; identical to SEQ ID NO: 1145

SEQ ID NO: 5402 - protein, 79 aa, Neisseria gonorrhoeae; identical to SEQ ID NO: 1146

SEQ ID NO: 5403 - DNA, 252 bp, Neisseria gonorrhoeae
atgccgtctgaacggctttcagacggcatcggtgcgatacgggaacgccggaacatcgaagctccggcgtttcaaatagggcggcggaccaaacccccggcactggcgcatcggagtgggctgctggcttccgcccctgacccggtgttccgatttgccatgcggggagacccgcaacggagaaacggcattataacgggttttctgaaaaactcaaccgttttgatacggtcatacgccggaaacaccgcc

SEQ ID NO: 5404 - protein, 84 aa, Neisseria gonorrhoeae
MPSERLSDGIGAIRERRNIEAPAFQIGRRTKPPALAHRSGLLASAPDPVFRFAMRGDPQRRNGIITGFLKNSTVLIRSYAGNTA

SEQ ID NO: 5405 - DNA, 3918 bp, Neisseria gonorrhoeae
ttgaactacattatcgccttttcaaacccggctgaaaccgacttttcaaacggcattcaaataaaaactgccaaacacggacacaccatgaccacgactaccgccccgcagcgtattcgggaaattccctacaactatacttcttataccgaccgcgaaatcgtcatccgcctgctgggcgacgaggcgtggcacattctgcaggacttgcgcggacagcgcaaaaccgggcgttcggcgcggatgttgtttgaagtgttgggcgatatttgggtggtcgtgcgcaatccgtatctggtcgatgatttgctggagcatccgaaacgccgcgccgcgttggtacgcgaaatgcgccacaggttgaacgaaatccgcaaacgccgcgacgataatcagcaagcggatgtgttgattgcggcggcggaaaaggcagtggagcgttttgacggcagctttgacgaaacgcgccaaaagcggcggcagattttggagcgtttgagcaaaattaccaagccgcacaatattatgtttgacgggctggcgcgggtaacacacgttaccgatgcgaccgactggcgcgtcgaatatccgtttgtcgtcgtcaatcccgacacggaggcggaagtcgcgcctttggtgcgcgccttaatcgaattggacttggttattatcccgcgcggcggcggtacgggttataccggcggcgcagtacctttggacgcaaacagcgcagtcatcaatacggaaaagctggacaagcatcgcggcgtggaatacgttgagctggcaggcttgtacggcagacatccgattatccggtgcggcgcgggcgtggttacgcggcgggtcgaagaaaccgcgcatcaggcgggcttggtgttcgccgtcgatccgacttccgccgacgcgtcctgcgtgggcggcaatgtggcgatgaatgcgggcggtaaaaaagccgtattgtggggtactgccttggacaacctcgcctactggaacatggttaaccctcaaggcgaatggctgcgtatcgaacgcgtgcgccacaatttcggcaaaatccacgacgaagaaactgccgtgttcgacgtgcacacgctggattcagacggcatcaacatcgttaaaaccgaacgcttggaaatccccggacacaaattccgcaaagtcggtttgggcaaagacgttaccgacaaatttttgagcggactgcccggcgtgcagaaagaaggtacggacggcatcattaccggcgttgccttcgtattgcacaaaatgccgaaatacacgcgcaccgtgtgtatggagtttttcggcacggccgccaccgccacgccttctatcgtcgaaatccgcgattttctgctcgcacacgacagcgtgcggctggcgggtttggagcatttggactggcgttatgtccgcgccgtcggctacgccaccaaagcggcgggcaaaggacgaccgaaaatggtcttgctggcggacgtggtttcagacgacgaagccgccgtagaggcagccgccgaacacatctgcgaacttgcccgcgcccgtgacggcgaaggctttatcgccgtatcgcccgaagcgcgcaaaaccttttggctcgaccgcagccgcaccgccgccatcgccaaacacaccaacgcctttaaaatcaacgaagacgtggtgattccgctggagaggctgggcgagtattcggacggcatcgaacgcatcaacatcgagctttccatccaaaacaaactcaaactctgtgccgctttggagcaatatctttcgggcaaactccccatcgacaaaatgggcaccgacctgccgaccgccgaactgttgggcgaacgcggcaaacacgccctcgcccacgttgccgccgtcaaagcgcgttgggactggctgctcgcccatttggatgcgccgcttgccgactacaaatcacgctacggtacagccgtccacgccgcgcccgaagccaaagacgatgaaagctgcttcaccgccttccgcgatttccgcctgcgcgtgtctgtcaaagcagacgtaatgaagccgcttgccgaaatcttcagcggcaaaaccgataccaaaattatccaaggcttgggcaaaatccacaccaaaaccgtacgcagccgcgtctttgtcgccctgcatatgcatgccggcgacggtaacgtccacaccaatattccggtcaactcagacgatgccgaaatgcttcagacggcctaccgttctgtggaacgcattatgaaaatcgcccgttcgctcggcggcgtgatttccggcgaacacggcatcggcatcaccaagctcgaattcctcaccgatgaagatttgcaaccgttttggaactacaaaaaccaagtcgaccccaagcacaccttcaaccgccacaaactgatgaaaggttcggacttacgcaacgcctacacgccgtctttcgagctgttgggcgcggaatcgctgattatggaaaaatcagacctcggcacgattgccgattccgtcaaagactgcctgcgctgcggcaaatgtaaacccgtctgctccacccacgttccgcgcgccaacctgctgtacagcccgcgcaacaaaatcctcggcgtgggtttgctgaccgaggccttcttatacgaagaacaaacccggcgcggcgtttccgtcaaacattttgaagaactgatggacatcggcgaccactgcaccgtgtgccaccgctgcgtcaaaccctgccccgtcaacatcgacttcggcgacgttaccgtagccgtccgcaactaccttgccgattccggccacaaacgctttgcgcctgcggcttcaatgggtatggcgtttttgaacgccaccggtccgaaaaccatcaaagccctgcgcgccgcgatgatacagaccggcttccccgcgcagaactttgcctacaaaatcggcaagcttcttccgatcggcacgaaaaagcaaaaagccgaacccaaggcaaccgtcggcaaagccccgattaaagaacaggttatccatttcatcaaccgcccactgcccaaaagcgtacccgccaaaacaccgcgctccttattgggcatcgaagacggcaaaagcatccccatcatccacaaccccgccgcgcccgaagatgccgaagccgtgttctacttccccggctgcggttcggagcgtttgttcagccaaatcggactcgccgtccaagccatgctctggcacgtcggcgtacaaaccgtcctgccgcccggctatatgtgttgcggctatccgcaagacgctggcggcaacaaggcaaaagccgaagaaatgagcaccaacaaccgcgtcgccttccaccgtatggcgaacaccctcaactacctcgacatcaaaaccgtcgtcgtcagttgcggcacttgttacgaccagcttgaaaaataccgcttcgaggaaatcttccccggctgccgcatcatcgacatccacgaatacctgctcgaaaaaggcgtgaaactcgacggcgtgaaaggtcagcaatacctctaccacgacccctgccacaccccgattaaaaccatgaacgccacccaaatggccagcagcctgatggggcagaaagtcgttttaagcgaccgctgctgcggcgaatccggtatgttcgccgtcaaacgccccgacatcgccacacaggtcaagttccgcaaacaagaggaaatcgagaaaaacctcaaagagctgccgcagggcgaacccgtcaaaatgctgacctcctgccccgcctgcctgcaaggactgagccgctattccgacgacaacaatatgcctgccgactacatcgtcattgaaatggcgaaacacatcctcggcgaaaactggctggatgagtttgtaaaaaaagccaacaacggcggcgtagagaaagtgttgcta

SEQ ID NO: 5406 - protein, 1306 aa, Neisseria gonorrhoeae
LNYIIAFSNPAETDFSNGIQIKTAKHGHTMTTTTAPQRIREIPYNYTSYTDREIVIRLLGDEAWHILQDLRGQRKTGRSARMLFEVLGDIWVVVRNPYLVDDLLEHPKRRAALVREMRHRLNEIRKRRDDNQQADVLIAAAEKAVERFDGSFDETRQKRRQILERLSKITKPHNIMFDGLARVTHVTDATDWRVEYPFVVVNPDTEAEVAPLVRALIELDLVIIPRGGGTGYTGGAVPLDANSAVINTEKLDKHRGVEYVELAGLYGRHPIIRCGAGVVTRRVEETAHQAGLVFAVDPTSADASCVGGNVAMNAGGKKAVLWGTALDNLAYWNMVNPQGEWLRIERVRHNFGKIHDEETAVFDVHTLDSDGINIVKTERLEIPGHKFRKVGLGKDVTDKFLSGLPGVQKEGTDGIITGVAFVLHKMPKYTRTVCMEFFGTAATATPSIVEIRDFLLAHDSVRLAGLEHLDWRYVRAVGYATKAAGKGRPKMVLLADVVSDDEAAVEAAAEHICELARARDGEGFIAVSPEARKTFWLDRSRTAAIAKHTNAFKINEDVVIPLERLGEYSDGIERINIELSIQNKLKLCAALEQYLSGKLPIDKMGTDLPTAELLGERGKHALAHVAAVKARWDWLLAHLDAPLADYKSRYGTAVHAAPEAKDDESCFTAFRDFRLRVSVKADVMKPLAEIFSGKTDTKIIQGLGKIHTKTVRSRVFVALHMHAGDGNVHTNIPVNSDDAEMLQTAYRSVERIMKIARSLGGVISGEHGIGITKLEFLTDEDLQPFWNYKNQVDPKHTFNRHKLMKGSDLRNAYTPSFELLGAESLIMEKSDLGTIADSVKDCLRCGKCKPVCSTHVPRANLLYSPRNKILGVGLLTEAFLYEEQTRRGVSVKHFEELMDIGDHCTVCHRCVKPCPVNIDFGDVTVAVRNYLADSGHKRFAPAASMGMAFLNATGPKTIKALRAAMIQTGFPAQNFAYKIGKLLPIGTKKQKAEPKATVGKAPIKEQVIHFINRPLPKSVPAKTPRSLLGIEDGKSIPIIHNPAAPEDAEAVFYFPGCGSERLFSQIGLAVQAMLWHVGVQTVLPPGYMCCGYPQDAGGNKAKAEEMSTNNRVAFHRMANTLNYLDIKTVVVSCGTCYDQLEKYRFEEIFPGCRIIDIHEYLLEKGVKLDGVKGQQYLYHDPCHTPIKTMNATQMASSLMGQKVVLSDRCCGESGMFAVKRPDIATQVKFRKQEEIEKNLKELPQGEPVKMLTSCPACLQGLSRYSDDNNMPADYIVIEMAKHILGENWLDEFVKKANNGGVEKVLL

SEQ ID NO: 5407 - DNA, 1023 bp, Neisseria gonorrhoeae
ttgaatcaaatacctacccgaatcatgattgacggacaaacaaccgaacccaaacaaaaaaccagaatcataccagcccccatgcgggggctggtagacgatgtgatgcgcgacctgctgacacgtatcggcggctacgacgaatgcgtcagcgaatttgtacgcattacccataccgtgcattcacgatccatatggttaaaatatgtccccgaaatcgccaacggaaacaaaacgttttccggcacgccctgcaccgtccaacttctgggcagcgatgcggacaatatggcggcaaacgcattggaagccgtccgattcggcgcggacaaaatcgatttgaacttcggctgccccgcgcccaccgtcaacaaacacaaaggcggcgcaattcttctgaaagagccggaactgatattccacatcgtcaaaacgctgcgcggacgtttgcctgcacatattccgctgacggggaaaatgcggctaggctatgaagacaaaagccctgctttggaatgcgcctgtgcgattgccgaagggggcgcgtgcggactgaccgtgcacgcgcgcaccaaagccgagggctacgaacccccggcgcattgggaatggataaggaaaatccacgataccgtcaatattcccgttaccgccaacggcgacgttttcagcctgcaggactatatcggcatcaaaacaatcagcggctgcaacagcgtgatgctcggtcgcggtgcggtcatccgccccgatttggcgcgccaaatcaagcaatacgagaacggcggaccggtcaaagacacggattttgccgaagtttccacatggatagggcagtttttcgagctgtgcctgacaaaagaggcaaacaacaaatacccgatcgcccgtcttaagcaatggctgggcatgatgaaaaaaacgttcgacccggcgcaaacgctgttcgaccgcgtccgaacggttaaagatgcggatgaagtgcgccgaatcctgaacgcatttgagcatgagatggatgtt

SEQ ID NO: 5408 - protein, 341 aa, Neisseria gonorrhoeae
LNQIPTRIMIDGQTTEPKQKTRIIPAPMRGLVDDVMRDLLTRIGGYDECVSEFVRITHTVHSRSIWLKYVPEIANGNKTFSGTPCTVQLLGSDADNMAANALEAVRFGADKIDLNFGCPAPTVNKHKGGAILLKEPELIFHIVKTLRGRLPAHIPLTGKMRLGYEDKSPALECACAIAEGGACGLTVHARTKAEGYEPPAHWEWIRKIHDTVNIPVTANGDVFSLQDYIGIKTISGCNSVMLGRGAVIRPDLARQIKQYENGGPVKDTDFAEVSTWIGQFFELCLTKEANNKYPIARLKQWLGMMKKTFDPAQTLFDRVRTVKDADEVRRILNAFEHEMDV

SEQ ID NO: 5409 - DNA, 180 bp, Neisseria gonorrhoeae
atgttttggtatgtaatcggcttttgcgcctttgtcgtcgcgctgctgtcgctgtgggtcaatgccggcgcgttcggtatgcaggaagacgataccccgcaatcggattatgaaaaacgtttgggtttgggggcgaaactgaaaaacaaaaatacaccgaaagcaggggaaaaacggcaa

SEQ ID NO: 5410 - protein, 60 aa, Neisseria gonorrhoeae
MFWYVIGFCAFVVALLSLWVNAGAFGMQEDDTPQSDYEKRLGLGAKLKNKNTPKAGEKRQ

SEQ ID NO: 5411 - DNA, 315 bp, Neisseria gonorrhoeae
ttgttatctttattgccgtttttcccctgctttcggtgtatttttgtttttcagtttcgcccccaaacccaaacgtttttcataatccgattgcggggtatcgtcttcctgcataccgaacgcgccggcattgacccacagcgacagcagcgcgacgacaaaggcgcaaaagccgattacataccaaaacattgcccctccaaatttgttaaaatcatatcaaatacagtgccgaatttatcacaagcgcacgagcaaataaatcttctgaccgcagtatttcattcatttaccttgaaaacaaaaaagggcacc

SEQ ID NO: 5412 - protein, 105 aa, Neisseria gonorrhoeae
LLSLLPFFPCFRCIFVFQFRPQTQTFFIIRLRGIVFLHTERAGIDPQRQQRDDKGAKADYIPKHCPSKFVKIISNTVPNLSQAHEQINLLTAVFHSFTLKTKKGT

SEQ ID NO: 5413 - DNA, 171 bp, Neisseria gonorrhoeae
ccggagccgcttccccgcgaagcggcttttccctttccgcgcactgtaaaaacagggcgaacaggcgtacaatcccaaccctttacttttgaatccgtttcgtttttcagacggcatcctgcttggaatgccgtctgaaaaaccgataggcaatacacacatgacccacat

SEQ ID NO: 5414 - protein, 45 aa, Neisseria gonorrhoeae
PEPLPREAAFPFPRTVKTGRTGVQSQPFTFESVSFFRRHPAWNAV

SEQ ID NO: 5415 - DNA, 105 bp, Neisseria gonorrhoeae
ttggttgtacctaagtcgataccgattacttttgccatgtggatactcctatttgattttgcttattttgagaaatatgttggaacattttgtcccgatgggctg

SEQ ID NO: 5416 - protein, 35 aa, Neisseria gonorrhoeae
LVVPKSIPITFAMWILLFDFAYFEKYVGTFCPDGL

SEQ ID NO: 5417 - DNA, 141 bp, Neisseria gonorrhoeae
ttgatggagcaaaggttgtacgaagggtggaaggcaacctgtgggtgtttggtatggtcgcgcttgaaaaaacgtgttttaagggacaaatgccgtctgaaaattggttttaagacggcattttcggtttgtgtgaaacaa

SEQ ID NO: 5418 - protein, 47 aa, Neisseria gonorrhoeae
LMEQRLYEGWKATCGCLVWSRLKKRVLRDKCRLKIGFKTAFSVCVKQ

SEQ ID NO: 5419 - DNA, 129 bp, Neisseria gonorrhoeae
atgagcgaaaccgcgaaaatcaaactcaacgaccggtccgaaaatgcagaaaaaccaaacgaaaaagtcgaactgcccattgtcgataacgacaaaaaaggcggacacggcgaaggcggttgctgcggc

SEQ ID NO: 5420 - protein, 43 aa, Neisseria gonorrhoeae
MSETAKIKLNDRSENAEKPNEKVELPIVDNDKKGGHGEGGCCG

SEQ ID NO: 5421 - DNA, 210 bp, Neisseria gonorrhoeae
ttgccgaaaaacgtatcagccgcagcaaccgccttcgccgtgtccgccttttttgtcgttatcgacaatgggcagttcgactttttcgtttggtttttctgcattttcggaccggtcgttgagtttgattttcgcggtttcgctcatttccttacctcatttggaaaacggtttgaaagattcataaatatagcatgtttaatccgaatc

SEQ ID NO: 5422 - protein, 70 aa, Neisseria gonorrhoeae
LPKNVSAAATAFAVSAFFVVIDNGQFDFFVWFFCIFGPVVEFDFRGFAHFLTSFGKRFERFINIACLIRI

SEQ ID NO: 5423 - DNA, 162 bp, Neisseria gonorrhoeae
atgtttaatccgaatctgaaaagggaagccgtatgcgaaatcccgtctgaagcccaatcagggcttcagacgggatttgctatctttattgccgcttttcttccgtatccggatttttgtttggggctgaagcagattggcagtcagattgcaatcgaagaa

SEQ ID NO: 5424 - protein, 54 aa, Neisseria gonorrhoeae
MFNPNLKREAVCEIPSEAQSGLQTGFAIFIAAFLPYPDFCLGLKQIGSQIAIEE

SEQ ID NO: 5425 - DNA, 810 bp, Neisseria gonorrhoeae
ttggcaggcgaattcggcacggcgctcgccggtcgcgttgcgaatccgtttggcgatgccagcaaagccattgatccttgggacagcaataataatgtggcttcgcaattgggtattttcaaacgccacgacggtatgccggtttccgtgcgttacgattcccccggattttccggtttcagcggcagcattcaatttgttccgagtcaaaacagcaagtccgcctatacgcctgctactttcacgctggaaagtaatcagatgaaaccagttccggctgttgtcggcaagccggggtcggatgtgtattatgccggtctgaattacaaaaatggcggctttttcggaaattatgcccttaaatatgcgaaacacgccaatgaggggcatgatgctttctttttgttcttgctcggcagagcgagtgataccgatccattgaaaaaccatcaggtacaccgcctgacgggcggctatggggaaggcggcttgaatctcgccttggcggctcagttggatttgtctgaaaatgccgacaaaaccaaaaacagtacgaccgaaattgccgccactgcttcctaccgcttcggtaatacagtcccgcgcatcagctatgcccatggtttcgactttgtcgaacgcagtcagaaacgcgaacataccagctatgatcaaatcatcgccggtgtcgattacgatttttccaagcgcacttccgccatcatgtctgccgcttggctgaaacgaaataccggcatcggcaactacactcaaattaatgccgcctccgttggtctgcgccacaaattc

SEQ ID NO: 5426 - protein, 270 aa, Neisseria gonorrhoeae
LAGEFGTALAGRVANPFGDASKAIDPWDSNNNVASQLGIFKRHDGMPVSVRYDSPGFSGFSGSIQFVPSQNSKSAYTPATFTLESNQMKPVPAVVGKPGSDVYYAGLNYKNGGFFGNYALKYAKHANEGHDAFFLFLLGRASDTDPLKNHQVHRLTGGYGEGGLNLALAAQLDLSENADKTKNSTTEIAATASYRFGNTVPRISYAHGFDFVERSQKREHTSYDQIIAGVDYDFSKRTSAIMSAAWLKRNTGIGNYTQINAASVGLRHKF

SEQ ID NO: 5427 - DNA, 1065 bp, Neisseria gonorrhoeae
ttgcaatcgaagaatgaaggcaagccatcaaaaacaaagctatccgcttcaccgccccgatatttagaatttgtggcgcagaccaacggaggcggcattaatttgagtgtagttgccgatgccggtatttcgtttcagccaagcggcagacatgatggcggaagtgcgcttggaaaaatcgtaatcgacaccggcgatgatttgatcatagctggtatgttcgcgtttctgactgcgttcgacaaagtcgaaaccatgggcatagctgatgcgcgggactgtattaccgaagcggtaggaagcagtggcggcaatttcggtcgtactgtttttggttttgtcggcattttcagacaaatccaactgagccgccaaggcgagattcaagccgccttccccatagccgcccgtcaggcggtgtacctgatggtttttcaatggatcggtatcactcgctctgccgagcaagaacaaaaagaaagcatcatgcccctcattggcgtgtttcgcatatttaagggcataatttccgaaaaagccgccatttttgtaattcagaccggcataatacacatccgaccccggcttgccgacaacagccggaactggtttcatctgattactttccagcgtgaaagtagcaggcgtataggcggacttgctgttttgactcggaacaaattgaatgctgccgctgaaaccggaaaatccgggggaatcgtaacgcacggaaaccggcataccgtcgtggcgtttgaaaatacccaattgcgaagccacattattattgctgtcccaaggatcaatggctttgctggcatcgccaaacggattcgcaacgcgaccggcgagcgccgtgccgaattcgcctgccaagccgataaaggattccctgttaccccaacgggtcgcgccgccgccggcaacggatacgtcttgctcgagctgccaaacagccttcagcccgccgcccaaatccccacccccttaaagccgataaacgagccgaaatcactgactttcgtcctgatgcggcttttggccttagtaactgtattgcccgtt

SEQ ID NO: 5428 - protein, 355 aa, Neisseria gonorrhoeae
LQSKNEGKPSKTKLSASPPRYLEFVAQTNGGGINLSVVADAGISFQPSGRHDGGSALGKIVIDTGDDLIIAGMFAFLTAFDKVETMGIADARDCITEAVGSSGGNFGRTVFGFVGIFRQIQLSRQGEIQAAFPIAARQAVYLMVFQWIGITRSAEQEQKESIMPLIGVFRIFKGIISEKAAIFVIQTGIIHIRPRLADNSRNWFHLITFQRESSRRIGGLAVLTRNKLNAAAETGKSGGIVTHGNRHTVVAFENTQLRSHIIIAVPRINGFAGIAKRIRNATGERRAEFACQADKGFPVTPTGRAAAGNGYVLLELPNSLQPAAQIPTPLKPINEPKSLTFVLMRLLALVTVLPV

SEQ ID NO: 5429 - DNA, 252 bp, Neisseria gonorrhoeae
atgttcctgccttccacaccagctttgacttcgccgtacaggctgacatcggcaactgccgcaaacggcagtgcggacaatacgagggcggtaagtttttttcgcatatcggcttccttttgtaaatttgctaaaaacatcgggcaaacacccaatcagtctccaattaccccccgaaaaaaaaaaaccatttttcggaacaaatttcgggtaaattttggaatttttattttgaaaaataatatttcaata

SEQ ID NO: 5430 - protein, 84 aa, Neisseria gonorrhoeae
MFLPSTPALTSPYRLTSATAANGSADNTRAVSFFRISASFCKFAKNIGQTPNQSPITPRKKKTIFRNKFRVNFGIFILKNNISI

SEQ ID NO: 5431 - DNA, 1881 bp, Neisseria gonorrhoeae
ttggccatttccgaaaacggtcaaaccaaagtcatcgaaaacgcagaaggcgcacgcaccacgccgtccattatcgcttatttggacggcggcgaaatcctcgtcggcgcgcctgccaaacgccaagcggtaaccaacgccaaaaacactatttacgccgccaaacgtttgatcggtcacaaatttgaagacaaagaagtccaacgcgacatcgaatctatgcctttcgaaatcatcaaagccgacaacggcgacgcatgggtaaaagcacaaggcaaagagctgtctcctcctcaaatttccgcagaagtcctgcgtaaaatgaaagaagccgccgaagcttacttgggcgaaaaagtaaccgaagccgtgattaccgtccctgcctacttcaacgacagccaacgtcaagccaccaaagacgcaggccgtatcgccggtttggacgtaaaacgcatcatcaacgagccgaccgcagccgctttggcattcggtatggacaaaggcgacaacaaagaccgcaaaatagccgtatatgacttgggcggcggtaccttcgatatttccatcatcgaaatcgccaacctcgacggcgacaaacaatttgaagtattggctaccaacggcgatactttcttgggcggtgaagacttcgaccaacgcttgattgactacatcattgacgagtttaaaaaagaacaaggcattgatttgaaacaagacgtaatggctctgcaacgtctgaaagaagctgccgaaaaagccaaaatcgaattgtccagcggccagcaaaccgaaatcaacctgccgtacattaccatggacgcaaccggcccgaaacacttggcaatgaaaattacccgcgccaaattcgagagcctggttgaagacctgattgcccgctctatcgagccttgccgcaccgcattgaaagatgccggcttgagcaccggcgacatcgacgacgtgattttggtcggcggtcagtcccgtatgccgaaagtacaagaagccgttaaagacttcttcggcaaagaaccgcgcaaagacgtgaaccctgacgaagccgttgccgtaggtgcagcgattcaaggcgaagtattgagcggcggccgcagcgacgtattgctgctggacgtaacccctctgtccttgggtatcgaaaccatgggtggtgtgatgaccaagctgattcaaaagaacactactattccgactaaagcgtctcaagtgttctctactgccgaagacaaccaaagcgcagtaaccatccacgtactgcaaggcgaacgcgaacgcgcttctgccaacaaatctttaggtcaattcaacttgggcgacatcgcacccgcaccacgcggtatgccgcaaattgaagttactttcgacatcgacgccaatggtatcttgcacgtttccgccaaagacaaaggcactggcaaagcggccaacattaccatccaaggttcttcaggtttgagcgaagaagaaatcgaacgcatggtgaaagatgccgaagccaatgccgaggaagataaaaagctgactgaattggtcgcttcccgcaaccaagccgaagccctgattcactccgtgaaaaaatctttggcggactacggcgacaaactcgacgctgccgagaaagaaaaaatcgaagccgcgctgaaagaagccgaagaagccgtgaaaggcgacgacaaaaccgccatcgatgccaaagccgaagcactgggtacagccagccaaaaactgggcgaaatggtttacgcgcaagcgcaagccgaagcccaagccggcgagggcgcacaagccaatgcttctgcaaagaaagacgatgatgtcgtagatgccgactttgaagaagtaaaagacgacaaaaaa

SEQ ID NO: 5432 - protein, 627 aa, Neisseria gonorrhoeae
LAISENGQTKVIENAEGARTTPSIIAYLDGGEILVGAPAKRQAVTNAKNTIYAAKRLIGHKFEDKEVQRDIESMPFEIIKADNGDAWVKAQGKELSPPQISAEVLRKMKEAAEAYLGEKVTEAVITVPAYFNDSQRQATKDAGRIAGLDVKRIINEPTAAALAFGMDKGDNKDRKIAVYDLGGGTFDISIIEIANLDGDKQFEVLATNGDTFLGGEDFDQRLIDYIIDEFKKEQGIDLKQDVMALQRLKEAAEKAKIELSSGQQTEINLPYITMDATGPKHLAMKITRAKFESLVEDLIARSIEPCRTALKDAGLSTGDIDDVILVGGQSRMPKVQEAVKDFFGKEPRKDVNPDEAVAVGAAIQGEVLSGGRSDVLLLDVTPLSLGIETMGGVMTKLIQKNTTIPTKASQVFSTAEDNQSAVTIHVLQGERERASANKSLGQFNLGDIAPAPRGMPQIEVTFDIDANGILHVSAKDKGTGKAANITIQGSSGLSEEEIERMVKDAEANAEEDKKLTELVASRNQAEALIHSVKKSLADYGDKLDAAEKEKIEAALKEAEEAVKGDDKTAIDAKAEALGTASQKLGEMVYAQAQAEAQAGEGAQANASAKKDDDVVDADFEEVKDDKK

SEQ ID NO: 5433 - DNA, 114 bp, Neisseria gonorrhoeae
atgtttgatggagcaaaggttgtacgaagggtggaaggcaacctgtgggtgtttggtatggtcgcgcttgaaaaaacgtgttttaagggacaaatgccgtctgaaaattggttt

SEQ ID NO: 5434 - protein, 38 aa, Neisseria gonorrhoeae
MFDGAKVVRRVEGNLWVFGMVALEKTCFKGQMPSENWF

SEQ ID NO: 5435 - DNA, 141 bp, Neisseria gonorrhoeae
atgttgcgggaaagcaacattttcaaaaaagttaatttattgttttatattgaaatattatttttcaaaataaaaattccaaaatttacccgaaatttgttccgaaaaatggtttttttttttcggggggtaattggagac

SEQ ID NO: 5436 - protein, 47 aa, Neisseria gonorrhoeae
MLRESNIFKKVNLLFYIEILFFKIKIPKFTRNLFRKMVFFFRGVIGD

SEQ ID NO: 5437 - DNA, 522 bp, Neisseria gonorrhoeae
atgcttgccgccgcaaaccggtgtgccggaatatggagaaaaagaccgatgcaaaaaatccccctgaccgtacgcggtgcggaattgctgaaacaggaattgcagcagctcaaaagcgtggcgcgtcccgaagtgatcgaagcgattgccgaagccagatcgcacggcgatttgtccgaaaacgccgaatacgaagccgccaaagaacgccaaggttttatcgagggccgcatttccgagttggaacacaaactttccgttgcccacatcatcaatccggccgaaatccacgccgaaggcaaaatcgtgttcggtacgacggttacgctggaagatttggaaacggaagaacacgttacctatcaaattgtcggcgaagacgaagccgacatcaaacagggcaaaatctatgtcggctctccgattgcccgcgccctgatcggcaaggaagaaggggatacggcggaagttcaggcaccgggcggcgtacgcgaatacgatattatcgaagtccggtatatt

SEQ ID NO: 5438 - protein, 174 aa, Neisseria gonorrhoeae
MLAAANRCAGIWRKRPMQKIPLTVRGAELLKQELQQLKSVARPEVIEAIAEARSHGDLSENAEYEAAKERQGFIEGRISELEHKLSVAHIINPAEIHAEGKIVFGTTVTLEDLETEEHVTYQIVGEDEADIKQGKIYVGSPIARALIGKEEGDTAEVQAPGGVREYDIIEVRYI

SEQ ID NO: 5439 - DNA, 594 bp, Neisseria gonorrhoeae
gtgtgtcgagtgtatcgaaatcaagccgaatcaaatataccggacttcgataatatcgtattcgcgtacgccgcccggtgcctgaacttccgccgtatccccttcttccttgccgatcagggcgcgggcaatcggagagccgacatagattttgccctgtttgatgtcggcttcgtcttcgccgacaatttgataggtaacgtgttcttccgtttccaaatcttccagcgtaaccgtcgtaccgaacacgattttgccttcggcgtggatttcggccggattgatgatgtgggcaacggaaagtttgtgttccaactcggaaatgcggccctcgataaaaccttggcgttctttggcggcttcgtattcggcgttttcggacaaatcgccgtgcgatctggcttcggcaatcgcttcgatcacttcgggacgcgccacgcttttgagctgctgcaattcctgtttcagcaattccgcaccgcgtacggtcagggggattttttgcatcggtctttttctccatattccggcacaccggtttgcggcggcaagcataccgcgtaccgtcttgttttgtgcgtccggatattaaaa

SEQ ID NO: 5440 - protein, 198 aa, Neisseria gonorrhoeae
VCRVYRNQAESNIPDFDNIVFAYAARCLNFRRIPFFLADQGAGNRRADIDFALFDVGFVFADNLIGNVFFRFQIFQRNRRTEHDFAFGVDFGRIDDVGNGKFVFQLGNAALDKTLAFFGGFVFGVFGQIAVRSGFGNRFDHFGTRHAFELLQFLFQQFRTAYGQGDFLHRSFSPYSGTPVCGGKHTAYRLVLCVRILK

SEQ ID NO: 5441 - DNA, 576 bp, Neisseria gonorrhoeae
gtgtgccggaatatggagaaaaagaccgatgcaaaaaatccccctgaccgtacgcggtgcggaattgctgaaacaggaattgcagcagctcaaaagcgtggcgcgtcccgaagtgatcgaagcgattgccgaagccagatcgcacggcgatttgtccgaaaacgccgaatacgaagccgccaaagaacgccaaggttttatcgagggccgcatttccgagttggaacacaaactttccgttgcccacatcatcaatccggccgaaatccacgccgaaggcaaaatcgtgttcggtacgacggttacgctggaagatttggaaacggaagaacacgttacctatcaaattgtcggcgaagacgaagccgacatcaaacagggcaaaatctatgtcggctctccgattgcccgcgccctgatcggcaaggaagaaggggatacggcggaagttcaggcaccgggcggcgtacgcgaatacgatattatcgaagtccggtatatttgattcggcttgatttcgatacactcgacacacgcaggaaattaaagcaccgcgtgtgtttttttatggtgttt

SEQ ID NO: 5442 - protein, 192 aa, Neisseria gonorrhoeae
VCRNMEKKTDAKNPPDRTRCGIAETGIAAAQKRGASRSDRSDCRSQIARRFVRKRRIRSRQRTPRFYRGPHFRVGTQTFRCPHHQSGRNPRRRQNRVRYDGYAGRFGNGRTRYLSNCRRRRSRHQTGQNLCRLSDCPRPDRQGRRGYGGSSGTGRRTRIRYYRSPVYLIRLDFDTLDTRRKLKHRVCFFMVF

SEQ ID NO: 5443 - DNA, 126 bp, Neisseria gonorrhoeae
ttgcggcggcaagcataccgcgtaccgtcttgttttgtgcgtccggatattaaaataaaaatacaagccgcccggaaaatcggcggcttgtctgtcgttgaacagcggctattctaccaaattcta

SEQ ID NO: 5444 - protein, 42 aa, Neisseria gonorrhoeae
LRRQAYRVPSCFVRPDIKIKIQAARKIGGLSVVEQRLFYQIL

SEQ ID NO: 5445 - DNA, 147 bp, Neisseria gonorrhoeae
ttgaacagcggctattctaccaaattctatgaaattggcaatcgtgccgtgccgccggcaaacgcgctatgtccgcaacaaaagccgaaaatatgccggcaaaaaaattttagaaacaaaaaatttaaaaaaaatcaattttcggca

SEQ ID NO: 5446 - protein, 49 aa, Neisseria gonorrhoeae
LNSGYSTKFYEIGNRAVPPANALCPQQKPKICRQKNFRNKKFKKNQFSA

SEQ ID NO: 5447 - DNA, 171 bp, Neisseria gonorrhoeae
gtggaaggtttgggcgaggcggcggggaggcggacggattcggtcatggcaaaacgtaaatataaagataaaaacagcctgcattatactggtgcaaatgccgtctggaaaatctcaggtttggcattttcggttttaaagtacgtgaatttggttttttatgccgaaaat

SEQ ID NO: 5448 - protein, 57 aa, Neisseria gonorrhoeae
VEGLGEAAGRRTDSVMAKRKYKDKNSLHYTGANAVWKISGLAFSVLKYVNLVFYAEN

SEQ ID NO: 5449 - DNA, 846 bp, Neisseria gonorrhoeae
atgctcgaagcactcgataaactcggcgttcaaatcgaacatcttgccgaaggccgtctgaaagtacacggcacgggcggacgcttccccaaccgctctgccgatttgtttttgggcaacgcgggcacggcgttccgtccgctgaccgccgcgctggccgttttgggcggcgattatcatctgcacggcgtgcctcgtatgcacgaacgccccatcggcgatttggtcgatgcgttgcggattgccggcgccgatgtcgaatatctcggcaacgaacactatccgccgcttcatatcggcaaacgtcaagactgcggcgagcgcgtgattcctattaaaggcaatgtgtccagccagtttctgaccgcccttttgatggcgttgccgctgaccgggcaggcgtttgaaatccgtatggtcggcgaattgatttccaagccctatatcgacattactttgaaactgatggcgcaattcggcgtacaggttgccaatgaaggctaccgcgttttcaaaatccctgccgatgcgcactatcacgcgcccgaacacttgcacgtcgaaggcgatgcctccggcgcgtcctacttcctcgcagccggtttgattgccgccacgcccgtccgcgttaccggcatcggcgcaaacagcatacagggcgatgtcgcctttgcccgcgaactggaaaaaatcggtgcggacgtggtttggggcgaaaacttcgtcgaagtctcgcgcccgaaaggacgcgccgtccaagcctttgatttggatgcgaaccatatccccgatgccgcgatgaccctggccatcgtcgcgcttgccacaaggcaaacctgcacgcta

SEQ ID NO: 5450 - protein, 282 aa, Neisseria gonorrhoeae
MLEALDKLGVQIEHLAEGRLKVHGTGGRFPNRSADLFLGNAGTAFRPLTAALAVLGGDYHLHGVPRMHERPIGDLVDALRIAGADVEYLGNEHYPPLHIGKRQDCGERVIPIKGNVSSQFLTALLMALPLTGQAFEIRMVGELISKPYIDITLKLMAQFGVQVANEGYRVFKIPADAHYHAPEHLHVEGDASGASYFLAAGLIAATPVRVTGIGANSIQGDVAFARELEKIGADVVWGENFVEVSRPKGRAVQAFDLDANHIPDAAMTLAIVALATRQTCTL

SEQ ID NO: 5451 - DNA, 1893 bp, Neisseria gonorrhoeae
atgacccacatgatttaccccaaaacctacgatgtcatcgtcgtcggcggcggacacgccggcacggaagccgcgcttgccgccgcccgtatgggcgcgcagacgcttttgctcacacacaatatcgaaacgctcggacaaatgtcgtgcaacccctctatcggcggcatcggcaaagggcatttggtacgcgaactcgacgcattgggcggcgcgatggcgttggcgaccgacaaatccggcatccagttccgccgcctgaacgccagcaaaggcgcggcagtacgagccacgcgcgcgcaggcagaccgcatcctgtataaagcctccatccgcgaaatgttggaaaaccaagaaaacctcgaccttttccaacaagccgtcgaagacgtaacactcgagggcgaacgcatcagcggcgtgatcaccgcgatgggcgtggagtttaaagcacgcgccgtggtgctgaccgcaggcacgttcttgtccggcaaaatccacatcggtttggaaaactacgaaggcggccgcgccggcgacccagccgccaaatcgctcggcggacgtttgcgcgaattgaagctgccgcaaggccgtctgaaaaccggcacgccgccgcgtattgacggacgcacgattgacttttcccaacttaccgaacagcccggcgacacgcccgttcccgtcatgtccgtgcgcggcaacgccgaaatgcacccgcgccaagtgtcctgctggattacgcataccaacacgcaaacccacgacatcatccgctcaggcttcgaccgcagcccgatgtttaccggcaaaatcgaaggcgtgggtccgcgttattgtccgtctatcgaagacaaaatcaaccgcttcgccgacaaagacagccaccagattttcctcgaacccgaaggtctgaccacgcacgaatactaccccaacggtatctccaccagcctgccgttcgacatccaaatcgcgctcgtgcgcagtatgaagggtcttgaaaacgcccatatcctgcgccccggctacgccatcgaatacgactacttcgatccgcgcaacctcaaagcaagcctcgaaaccaaaaccattgagggactgtttttcgccgggcaaatcaacggcacgacaggctatgaagaagccgccgcgcaaggattgctggcgggcgcgaacgccgtgcaatacgtccgcggacaagatccgctcctgctgcgccgcgaacaagcctacctcggcgtattggtggacgacctcattaccaaaggcctgaacgaaccttaccggatgtttaccagccgcgccgaataccgcctgcaactcagggaagacaacgccgatatgcgcctgaccgaagacggctacaaaatcggcttggtgggtgaagcgcaatggcgcatgttcaacgaaaaacgcgaagccgtcgaacgcgaaatccaacgtttgaaaacaacgtggtacacgccgcaaaaactcgccgaagacgaacaaatccgcgtgttcgggcaaaagctcagccgcgaagccaacctgcacgatttgttacgccgcccgaacctcgactacgccgcactgatgacgctcgaaggcgcgatgccgtctgaaaacctctctgccgaagtcatcgagcaagtcgaaatccaagtcaaataccaaggctatatcgaccgccaaaacgaagaaatcgacagccgccgcgacatcgaaaccttaaaactgcccgacggcatcgattacggcagagtcaaaggcttgtcggcagaagtgcaacaaaagctcaaccagcacaaacccgaaaccgtcgggcaggcaagccgcatttccggcgttacgcctgccgccgtcgcactgctgatggtgcatttgaagcgcgggtttaaagacgcgaaa

SEQ ID NO: 5452 - protein, 631 aa, Neisseria gonorrhoeae
MTHMIYPKTYDVIVVGGGHAGTEAALAAARMGAQTLLLTHNIETLGQMSCNPSIGGIGKGHLVRELDALGGAMALATDKSGIQFRRLNASKGAAVRATRAQADRILYKASIREMLENQENLDLFQQAVEDVTLEGERISGVITAMGVEFKARAVVLTAGTFLSGKIHIGLENYEGGRAGDPAAKSLGGRLRELKLPQGRLKTGTPPRIDGRTIDFSQLTEQPGDTPVPVMSVRGNAEMHPRQVSCWITHTNTQTHDIIRSGFDRSPMFTGKIEGVGPRYCPSIEDKINRFADKDSHQIFLEPEGLTTHEYYPNGISTSLPFDIQIALVRSMKGLENAHILRPGYAIEYDYFDPRNLKASLETKTIEGLFFAGQINGTTGYEEAAAQGLLAGANAVQYVRGQDPLLLRREQAYLGVLVDDLITKGLNEPYRMFTSRAEYRLQLREDNADMRLTEDGYKIGLVGEAQWRMFNEKREAVEREIQRLKTTWYTPQKLAEDEQIRVFGQKLSREANLHDLLRRPNLDYAALMTLEGAMPSENLSAEVIEQVEIQVKYQGYIDRQNEEIDSRRDIETLKLPDGIDYGRVKGLSAEVQQKLNQHKPETVGQASRISGVTPAAVALLMVHLKRGFKDAK

SEQ ID NO: 5453 - DNA, 465 bp, Neisseria gonorrhoeae; identical to SEQ ID NO: 1205

SEQ ID NO: 5454 - protein, 155 aa, Neisseria gonorrhoeae; identical to SEQ ID NO: 1206

SEQ ID NO: 5455 - DNA, 246 bp, Neisseria gonorrhoeae
atggcgaacgagttgcgcaaactcggtgcaaaagtcgtcgaagaagccgaagcgattcacattaccccgcccgaaacgccgacacccgatgccgtcatcgacacttacgacgaccaccgcatggcgatgtgtttctcgctgatttcgctgttgggagtacccgtcgtcatcaacgacccgaaatgcacccataaaaccttcccgacttattttgaagtgttctcatcactgaccgaaacagcggaa

SEQ ID NO: 5456 - protein, 82 aa, Neisseria gonorrhoeae
MANELRKLGAKVVEEAEAIHITPPETPTPDAVIDTYDDHRMAMCFSLISLLGVPVVINDPKCTHKTFPTYFEVFSSLTETAE

SEQ ID NO: 5457 - DNA, 102 bp, Neisseria gonorrhoeae
atgagccgcccgccgcgccggaatcgcggcaaaatgccgtctgaagccctgttttcgggtttcagacggcatttttccgccttattccgctgtttcggtcag

SEQ ID NO: 5458 - protein, 34 aa, Neisseria gonorrhoeae
MSRPPRRNRGKMPSEALFSGFRRHFSALFRCFGQ

SEQ ID NO: 5459 - DNA, 645 bp, Neisseria gonorrhoeae
ttggaaacgcatcgccgcaaaaatcctatccctgctgcccatcgaaggtttattatagaaatgccgtctgaaacaccttcagacggcatatccgaacccgcaaaggaaaaaaccatgttttcccccgacaaaacccttttcctctgtctcggcgcactgctcctcgcctcatgcggcacgacctccggcaaacaccgccaaccgaaacccaaacagacagtccggcaaatccaagccgtccgcatcagccacatcggccgcacacaaggctcgcaggaactcatgctccacagcctcggactcatcggcacgccctacaaatggggcggcagcagcaccgcaaccggcttcgactgcagcggcatgattcaattcgtttacaaaaacgccctcaacgtcaagctgccgcgcaccgcccgcgacatggcggcggcaagccgcaaaatccccgacagccgcctcaaggccggcgacctcgtattcttcaacaccggcggcgcacaccgctactcacacgtcggactctacatcggcaacggcgaattcatccatgcccccggcagcggcaaaaccatcaaaaccgaaaaactctccacaccgttttacgccaaaaactaccttggagcgcatacgttttttacagaa

SEQ ID NO: 5460 - protein, 215 aa, Neisseria gonorrhoeae
LETHRRKNPIPAAHRRFIIEMPSETPSDGISEPAKEKTMFSPDKTLFLCLGALLLASCGTTSGKHRQPKPKQTVRQIQAVRISHIGRTQGSQELMLHSLGLIGTPYKWGGSSTATGFDCSGMIQFVYKNALNVKLPRTARDMAAASRKIPDSRLKAGDLVFFNTGGAHRYSHVGLYIGNGEFIHAPGSGKTIKTEKLSTPFYAKNYLGAHTFFTE

SEQ ID NO: 5461 - DNA, 1575 bp, Neisseria gonorrhoeae
atgcatacagaccccaaaatacaggcaatgccgtctgaaactatatccccgatgaaaacacgcagcctcatttcccttttatgcctccttctctgttcatgttcttcatggttgcccccactggaagaacggacggaaagccgtcattttaatacttccaaacctgtcctcctggacaacatcctgcaaatccggcacacccctcataacaacgggctatccgacatctacctgctcgacgacccccacgaagcctttgccgcccgcgccgcccttatcgaatctgccgaacacagcctcgatttgcaatactacatttggcgcaacgacatttccggcaggctgctgttcaacctcatgtaccttgccgcagaacgcggcgtgcgcgtacgcctgctgttggacgacaacaacacgcgcggcttggacgatctcctgctcgccctcgacagccatcccaatatcgaagtgcgcctgttcaaccccttcgtcctacgcaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgacctggacatcctcgccaccggcagcgtcgtcggcgaagtatcgcacgacttcgaccgctactgggcaagccattccgcccacaacgccacgcgcatcatccgcagcggcaacatcggcaagggtcttcaagcactcggatacaacgacgaaacatccagacacgcgctcctgcgctaccgcgaaaccgtcgaacagtcgcccctctaccaaaaaatacagacgggacgcatcgactggcagagcgtccaaacccgcctgatcagcgacagccctgcaaaaggactcgaccgcgaccgccgcaaaccgccgattgccgggaggctgcaagacgcgctcaaacagcccgaaaaaagcgtctatctggtttcaccctatttcgtccctacaaaatccggcacagacgcactggcaaaactggtgcaggacggcatagacgttaccgtcctgaccaactcgctacaggcgaccgacgttgccgccgtccattccggctacgtcaaataccgaaaaccgctgctcaaagccggcatcaaactctacgagctgcaacccaaccatgccgtccccgccacaaaagacaaaggcctgaccggcagctccgtaaccagcctgcatgccaaaaccttcattgtggacggcaaacgcatcttcatcggctcattcaacctcgacccccgttccgcacggctcaataccgaaatgggcgtcgtcatcgaaagccccaaaatcgcagaacagatggagcgcaccctcgccgataccacacccgaatacgcctaccgcgttaccctcgacaaacacaaccgcctgcaatggcacgatcccgccacccgaaaaacctacccgaacgaacccgaagccaaactttggaaacgcatcgccgcaaaaatcctatccctgctgcccatcgaaggtttatta

SEQ ID NO: 5462 - protein, 525 aa, Neisseria gonorrhoeae
MHTDPKIQAMPSETISPMKTRSLISLLCLLLCSCSSWLPPLEERTESRHFNTSKPVLLDNILQIRHTPHNNGLSDIYLLDDPHEAFAARAALIESAEHSLDLQYYIWRNDISGRLLFNLMYLAAERGVRVRLLLDDNNTRGLDDLLLALDSHPNIEVRLFNPFVLRKWRALGYLTDFPRLNRRMHNKSFTADNRATILGGRNIGDEYFKVGEDTVFADLDILATGSVVGEVSHDFDRYWASHSAHNATRIIRSGNIGKGLQALGYNDETSRHALLRYRETVEQSPLYQKIQTGRIDWQSVQTRLISDSPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTTPEYAYRVTLDKHNRLQWHDPATRKTYPNEPEAKLWKRIAAKILSLLPIEGLL

SEQ ID NO: 5463 - DNA, 1539 bp, Neisseria gonorrhoeae
atgattttcgataataattatcattacaatgcaatgccgattcgtttgcttgtgaacattcaggatgccgactctgccggcattcagacagcatctgaaaacaataacggcacaaggatggggtacaatcaccctatggaaaaaaacaccctgtccgcccgcgcaccatccccttggctgccgcttctgctggcaattgccatttttatgcagatgttggatgcgaccattttaaataccgcactgcccgaaattgccgccgacctgaacgaatcgcctccggatatgcaacaggcagtcgttgcctatacgctgacggttgccctgctgattcctttgagcagttatttggcggacaagttcggaacgaaaaaagtctttttcggttcgattgccgtttttatgctcggatcggcattgggcgccgcatcgggttcgctgtttgaattgacgctttcccgtgtcgttcaggggatcggcggttcgatgctggttccgataccgcgtctgaccatcttgcgtgtatatgaaaaatcgaagctgctcaacgccatcaattatgcggtcatgcctgcactgatcggccctgcgttgggacctctggcgggcggttatctggtcgaatacgcttcgtggcactggattttcctgctcaacctgcccatcggtctgctgggtttcgtattgggacgcaacatcatgcccgatgtcaaaggcaacgataccgctctggatttcaaaggctatctgaccttttccgttgccgcctgcctgctgctgcttgcggcagaaagcctgtcgcacgcgctgcctccgtattttgcactgttaccgctgtgcggcggactgctgtttgcacgccgttatttccgacatatgaaaaccgcgtccaaaccgatttattccgccgacctgtttctgatacgcaccttccgtttgggactggcgggcaatctgttcagccgtctcggcatcagctcgattccttttctgatgcccctgatgtttcaagtcgctttcggcttcggcgcaagcctgtcgggctggctggtcgcacccgtcgccctgtcttcgctgctggtcaaaccgctgattgcaccgctcatgaaacgtttcggctaccgcacggtactgctttggaacaccaagctgcttgccgccttcatcatgctgctcgccctgcctgacggaaactcgccgctgtggatttggattttcctctcgctggcgatcggcgcatgcaactccctacagttttctgccatgaacacactgaccctcgccgatttgcgcccgcaacagaccggcagcggcaacagcctgatggcggtcaaccaacagcttgccatcagcgtgggcattgttgccggcgcattaatccttaaaaactggacatttctgataccggcttcttcaggcctgcatttcgccttccgtatgaccctgctcagtatcggcggcatcacccttgcctcgtcgttggtttttaagcgtctgcacgtttcagacggtgcaaacctgacaagaggcacgcggcct

SEQ ID NO: 5464 - protein, 513 aa, Neisseria gonorrhoeae
MIFDNNYHYNAMPIRLLVNIQDADSAGIQTASENNNGTRMGYNHPMEKNTLSARAPSPWLPLLLAIAIFMQMLDATILNTALPEIAADLNESPPDMQQAVVAYTLTVALLIPLSSYLADKFGTKKVFFGSIAVFMLGSALGAASGSLFELTLSRVVQGIGGSMLVPIPRLTILRVYEKSKLLNAINYAVMPALIGPALGPLAGGYLVEYASWHWIFLLNLPIGLLGFVLGRNIMPDVKGNDTALDFKGYLTFSVAACLLLLAAESLSHALPPYFALLPLCGGLLFARRYFRHMKTASKPIYSADLFLIRTFRLGLAGNLFSRLGISSIPFLMPLMFQVAFGFGASLSGWLVAPVALSSLLVKPLIAPLMKRFGYRTVLLWNTKLLAAFIMLLALPDGNSPLWIWIFLSLAIGACNSLQFSAMNTLTLADLRPQQTGSGNSLMAVNQQLAISVGIVAGALILKNWTFLIPASSGLHFAFRMTLLSIGGITLASSLVFKRLHVSDGANLTRGTRP

SEQ ID NO: 5465 - DNA, 777 bp, Neisseria gonorrhoeae
atgagcgcaaccattcccccaaaaatcatccgatacgacagcaatccgacagatgtctattttttcggcacttgcgtccttgatctttttatgcccgaagcaggcatggatgccattgccctaatcgagcagcagggcatacgcgtccatttcccgatggcgcaaagctgctgcggtcagcctgcctattcatccggccatccgaccgaagccttcgatgtcgccaaagtgcaactcgaccttttccccgaaaactggccgattgtcgtaccgtccggctcatgcggcggcatgatgaaacatcactggcctaccctgtttaaaaatacagaatacgaatccaaagcggttgattgtgccaaccgtatcattgagtttactcatttcttgcttgccatcggctacaagcctgaagacaaaggcgagccagtcaaagtcgccgttcacacttcctgtgccgcccgccgagaaatgaatgtccatctttcaggctggcagttgattgacggtatggaaaacgtcgaacgcatcgtccacgaccacgaaagcgagtgttgcggcttcggcggcacattctccgtcaaacaagccgatatttccggcgcgatggtaaccgacaaagttgccgcgctgaaagaaaccggcgcaaccgaaatcatcagcgcggactgcggctgtatgatgaacatcggaggcaaaatcgccaaggacgagccggatatgccgcgtccgaagcatatcgcatccttcttgttggaacgcaccggaggcaaagta

SEQ ID NO: 5466 - protein, 259 aa, Neisseria gonorrhoeae
MSATIPPKIIRYDSNPTDVYFFGTCVLDLFMPEAGMDAIALIEQQGIRVHFPMAQSCCGQPAYSSGHPTEAFDVAKVQLDLFPENWPIVVPSGSCGGMMKHHWPTLFKNTEYESKAVDCANRIIEFTHFLLAIGYKPEDKGEPVKVAVHTSCAARREMNVHLSGWQLIDGMENVERIVHDHESECCGFGGTFSVKQADISGAMVTDKVAALKETGATEIISADCGCMMNIGGKIAKDEPDMPRPKHIASFLLERTGGKV

SEQ ID NO: 5467 - DNA, 1245 bp, Neisseria gonorrhoeae; identical to SEQ ID NO: 9

SEQ ID NO: 5468 - protein, 415 aa, Neisseria gonorrhoeae; identical to SEQ ID NO: 10

SEQ ID NO: 5469 - DNA, 699 bp, Neisseria gonorrhoeae
atgagcgcgcgcgaaaatattttggcaaaactgaaaaaagccggcgcattgccgatggaagagcctgcggtttttgattattaccgcgaaaagggcgtttcttgggacagcgaagccgagcgtctgaaacattgggctgccgccatgcgcgcggtcaaaaccgaaatctattgggtgacgaaaagcaattggatgcaggttttccgcgaagcggcagaaggcaagggtttaaaaaacatcctgctgcccttggcaaccgaacacggacaaattgcccgtgccgcattggcgggcagcaatatcgacccgattgccttcgagcgcgaaatcgatacttggaaaaccgagtttttcacgaacatcgatgcaggcttcagcggcgcgcaatgcggcatcgcccgcaccggcacgctgatgctgttttccagccctgaagaaccgcgtactttgagcctcgttccgcccgtgcatttctgcctgttcgatacgtccaagatgtacaacgagtttcacaacgccgtcgaaggcgaaaaactggtggaaaacggtatgccgaccaatgtattcctgatttccggcccgtccaaaaccgcagacatccagttgacgctcgcttacggtgcgcacggtccgcgtgatttggtcatcctcgccattttgcccgaccacatttcccctgccgatttggaggaaaacgca

SEQ ID NO: 5470 - protein, 233 aa, Neisseria gonorrhoeae
MSARENILAKLKKAGALPMEEPAVFDYYREKGVSWDSEAERLKHWAAAMRAVKTEIYWVTKSNWMQVFREAAEGKGLKNILLPLATEHGQIARAALAGSNIDPIAFEREIDTWKTEFFTNIDAGFSGAQCGIARTGTLMLFSSPEEPRTLSLVPPVHFCLFDTSKMYNEFHNAVEGEKLVENGMPTNVFLISGPSKTADIQLTLAYGAHGPRDLVILAILPDHISPADLEENA

SEQ ID NO: 5471 - DNA, 1452 bp, Neisseria gonorrhoeae
atgactacgcaaaccatcaagttccacatgaagccggaaactttcaaacaaaacgccgcaatttcccttcaagacaagcccttgcgtaaaagcctgcgtaccgcgatggatatgctgatgaccaagcgcaaagccgttttgaccgacgaagaagagttgcaaagcctgcgcgatttgtgcgaacacatccgtcagcgttccctctccaaattacccgcgctgctggagcagttggaagaaaacctgactaagttgggcgtgaaagtacactgggcggaaacccctgccgaagcctgccaaattatccacgacatcatcacagccaaaaacggcaagctgatggtcaaaggcaaatccatggtcagcgaagaaatcgagctgaaccattatcttgaagcaaaaggcattaaggcggtggaaagcgacttgggcgagtttatcgtccaaatggcaggcgaaaaaccgacccatatcgtgatgcccgcaatccataaaaccaaagaacaggtcagcgaactgttccaccaaaacctcggcacaccgcttacagacgacgtggaccaactgaccggattcgcccgcaaagccctgcgcgatatttacagcactgccgatgtcggcttgagcggcgtaaacttcgccgttgccgaaacgggcacgctgtgtctggtcgaaaacgaaggcaacggccgcttgagtactaccgttccgcccgtacatatcgtcattacgggtattgaaaaagttgtcgccaagctgtctgatgttccgcctttgtacagtctgctgccgcgttccgccatcggtcagaacattaccacttatttcaatatgattaccggcccgcgccgcagtgaagaattagacggtccgcaggaaatgcacttggttttgctcgacaacggccgcagccaagcttatgccgaagaccaaatgcgccgcaccctgcaatgtatccgttgcggcgcgtgtatgaaccattgcccggtttatacacgcatcggcggcgcggcatacggcacaacctatcccggtccgattggcgagattatttccccgcacctgttgggtcttgatgccacccgcgacctgccgaccgcctgcacgatgtgcggcgcgtgcgtggaagtttgtccggtacgcatcccgattaccgaacaaatgcaacgtttgcgcgttgaagcacaacgttcgccgaccgaaaccgtgccgcaccccatccgagggcaaggcgcatcgcataccttcggcgaacaaatggcgtggcgcacattcaacggtattttcagcggtagcaaaacctaccgcgccttcggttgggcagccaccaagttccgcaatctgaccccgcgcaaacagttgggttggacgcaaaaccgcgtaccgatgaaaccggcgaagaaaaccctgcacgaactgatggcggaaaaaatgcgccaaaaagaacaggca

SEQ ID NO: 5472 - protein, 484 aa, Neisseria gonorrhoeae
MTTQTIKFHMKPETFKQNAAISLQDKPLRKSLRTAMDMLMTKRKAVLTDEEELQSLRDLCEHIRQRSLSKLPALLEQLEENLTKLGVKVHWAETPAEACQIIHDIITAKNGKLMVKGKSMVSEEIELNHYLEAKGIKAVESDLGEFIVQMAGEKPTHIVMPAIHKTKEQVSELFHQNLGTPLTDDVDQLTGFARKALRDIYSTADVGLSGVNFAVAETGTLCLVENEGNGRLSTTVPPVHIVITGIEKVVAKLSDVPPLYSLLPRSAIGQNITTYFNMITGPRRSEELDGPQEMHLVLLDNGRSQAYAEDQMRRTLQCIRCGACMNHCPVYTRIGGAAYGTTYPGPIGEIISPHLLGLDATRDLPTACTMCGACVEVCPVRIPITEQMQRLRVEAQRSPTETVPHPIRGQGASHTFGEQMAWRTFNGIFSGSKTYRAFGWAATKFRNLTPRKQLGWTQNRVPMKPAKKTLHELMAEKMRQKEQA

SEQ ID NO: 5473 - DNA, 420 bp, Neisseria gonorrhoeae; identical to SEQ ID NO: 287

SEQ ID NO: 5474 - protein, 140 aa, Neisseria gonorrhoeae; identical to SEQ ID NO: 288

SEQ ID NO: 5475 - DNA, 384 bp, Neisseria gonorrhoeae
atggattgttccaaacgttcgtgcagcacattctttttcttgccattgagcaacaacgccacacccaaacgcaattctgcaacagtaatggcagacaaatacacatcttccaatatcaaactatccaaccatgccaccacacgttcattgggttgtgggcgcaaaggttcggaaatcacattcgtgtccagcaaaatcatcacaaagaaacctcgttatcagtattacgaccgcgtacgtcttccagctcaacacctccgatttcctgccctattgatgccaacattgaccccaaacgtacagtttgttgtgctttggcgatgttatccaaaattaagcggatttctgcttcggtactgcgccctgcggctcgcgcacggaatt

SEQ ID NO: 5476 - protein, 128 aa, Neisseria gonorrhoeae
MDCSKRSCSTFFFLPLSNNATPKRNSATVMADKYTSSNIKLSNHATTRSLGCGRKGSEITFVSSKIITKKPRYQYYDRVRLPAQHLRFPALLMPTLTPNVQFVVLWRCYPKLSGFLLRYCALRLAHGI

SEQ ID NO: 5477 - DNA, 444 bp, Neisseria gonorrhoeae
ttgttccaaacgttcgtgcagcacattctttttcttgccattgagcaacaacgccacacccaaacgcaattctgcaacagtaatggcagacaaatacacatcttccaatatcaaactatccaaccatgccaccacacgttcattgggttgtgggcgcaaaggttcggaaatcacattcgtgtccagcaaaatcatcacaaagaaacctcgttatcagtattacgaccgcgtacgtcttccagctcaacacctccgatttcctgccctattgatgccaacattgaccccaaacgtacagtttgttgtgctttggcgatgttatccaaaattaagcggatttctgcttcggtactgcgccctgcggctcgcgcacggaatttgattgcgttgtgcgtggcctcggataaatttctaatcacaacagaagccattgcctttccttcc

SEQ ID NO: 5478 - protein, 148 aa, Neisseria gonorrhoeae
LFQTFVQHILFLAIEQQRHTQTQFCNSNGRQIHIFQYQTIQPCHHTFIGLWAQRFGNHIRVQQNHHKETSLSVLRPRTSSSSTPPISCPIDANIDPKRTVCCALAMLSKIKRISASVLRPAARARNLIALCVASDKFLITTEAIAFPS

SEQ ID NO: 5479 - DNA, 264 bp, Neisseria gonorrhoeae
ttgaaaaacttttttcaggaaggaaaggcaatggcttctgttgtgattagaaatttatccgaggccacgcacaacgcaatcaaattccgtgcgcgagccgcagggcgcagtaccgaagcagaaatccgcttaattttggataacatcgccaaagcacaacaaactgtacgtttggggtcaatgttggcatcaatagggcaggaaatcggaggtgttgagctggaagacgtacgcggtcgtaatactgataacgaggtttctttg

SEQ ID NO: 5480 - protein, 88 aa, Neisseria gonorrhoeae
LKNFFQEGKAMASVVIRNLSEATHNAIKFRARAAGRSTEAEIRLILDNIAKAQQTVRLGSMLASIGQEIGGVELEDVRGRNTDNEVSL

SEQ ID NO: 5481 - DNA, 138 bp, Neisseria gonorrhoeae
ttgattaaactgtccgactttttggggtgcagttcaagagcgactgttttttatttatcagaaagagggaggggagacgtttttttagatgtaaaaaaacgcctgcggccacctgaattttcaggcatccgcaggcgt

SEQ ID NO: 5482 - protein, 46 aa, Neisseria gonorrhoeae
LIKLSDFLGCSSRATVFYLSERGRGDVFLDVKKRLRPPEFSGIRRR

SEQ ID NO: 5483 - DNA, 483 bp, Neisseria gonorrhoeae
atgagaaaatgggtaacggacgttaccaagttcgatgtaggcggagaaaagatatacctttctccgattatggatttgtttaacggggaaatcgtcagttaccgtattcaaacccgcccgactttcgatttggccggcgagatactgaaaggtgcgccggagaaaccggggccgtctgaaaagccgatgctgcattcggatcaaggttggcaatatcagatgtttttttatcaaaagcagttgaaaggcaacggtctggttcagagtctgtcccgcaagggaaactgcttggacaatgcggcaatggaaagtttcttcggaacgttgaaatcggaatgtttccatacgtgcaaatatgattccgttaccgaatcggaagcggcactgcacgaatatatccgttactacaacaacgatagaatcaagttgaaattaaaaggactgagccctgttcagtacagaattcagtccctgaaagccgct

SEQ ID NO: 5484 - protein, 161 aa, Neisseria gonorrhoeae
MRKWVTDVTKFDVGGEKIYLSPIMDLFNGEIVSYRIQTRPTFDLAGEILKGAPEKPGPSEKPMLHSDQGWQYQMFFYQKQLKGNGLVQSLSRKGNCLDNAAMESFFGTLKSECFHTCKYDSVTESEAALHEYIRYYNNDRIKLKLKGLSPVQYRIQSLKAA

SEQ ID NO: 5485 - DNA, 636 bp, Neisseria gonorrhoeae
atgccgtctgaaaccattttcagacggcatcgtaccatcccgacaggaaacatcatgcacatactgaccgccggcgtggacgaggcaggacgcggacctttggtcggcagcgtgtttgccgccgccgtcatccttccggaaacattcgacctgcccggactgaccgactccaaaaaactcagcgagaaaaaacgcgacgcgcttgccgaaatgattaaagaacaggcggtcgcgtggcacgtcgccgcctccacgcccgaagaaatcgcaagcctcaacatcctgcacgccaccatgctcgccatgaaacgtgccgtttacggtttggctgcgcgtcccgaaaaaatattcatcgacggcaaccgcattcccgaacatttaggcatccctgccgaagcagtcgtcaaaggcgacagcaaaatcatcgaaatctccgccgcatccgttttggcaaagaccgcacgcgatgcggaaatgtacgcactggcgcaacgccgtccccaatacggtttcgacaaacacaaaggttacggcacaaagcagcatctggaagccctcaaacaatacggcgtgctgcccgaacaccgccgcgacttcgcccccgtcagaaacctgctcgcgcagcaggccttgttt

SEQ ID NO: 5486 - protein, 212 aa, Neisseria gonorrhoeae
MPSETIFRRHRTIPTGNIMHILTAGVDEAGRGPLVGSVFAAAVILPETFDLPGLTDSKKLSEKKRDALAEMIKEQAVAWHVAASTPEEIASLNILHATMLAMKRAVYGLAARPEKIFIDGNRIPEHLGIPAEAVVKGDSKIIEISAASVLAKTARDAEMYALAQRRPQYGFDKHKGYGTKQHLEALKQYGVLPEHRRDFAPVRNLLAQQALF

SEQ ID NO: 5487 - DNA, 339 bp, Neisseria gonorrhoeae
atgccatccgttgaactgctgttggggattgtcggactgccacgcagcaccttctattaccaattggccgtccaatcggcagaaggcaaatatgccgatttgaaacgacatatccatgatatttatcaacgatataagggaagatacggctaccggaggattgcggcagccatccgtcacgcaggaataccggtcaatcacaagaaagtcagccgtctgatggcgaagacggggctgaaggcagtgatacggcggcgcaaataccgctcgttcaaaggagaagtcggcaaagttgcgccgaacatcctgcaacgctgtttccattcagaaaagccggaa

SEQ ID NO: 5488 - protein, 113 aa, Neisseria gonorrhoeae
MPSVELLLGIVGLPRSTFYYQLAVQSAEGKYADLKRHIHDIYQRYKGRYGYRRIAAAIRHAGIPVNHKKVSRLMAKTGLKAVIRRRKYRSFKGEVGKVAPNILQRCFHSEKPE

SEQ ID NO: 5489 - DNA, 408 bp, Neisseria gonorrhoeae
atggaaacagcgttgcaggatgttcggcgcaactttgccgacttctcctttgaacgagcggtatttgcgccgccgtatcactgccttcagccccgtcttcgccatcagacggctgactttcttgtgattgaccggtattcctgcgtgacggatggctgccgcaatcctccggtagccgtatcttcccttatatcgttgataaatatcatggatatgtcgtttcaaatcggcatatttgccttctgccgattggacggccaattggtaatagaaggtgctgcgtggcagtccgacaatccccaacagcagttcaacggatggcatttccttaaccctgcgacgagttgcgttctttctgccgcacttctttcaaggcatcgagcttttttaggacagccgcttccgctt

SEQ ID NO: 5490 - protein, 136 aa, Neisseria gonorrhoeae
METALQDVRRNFADFSFERAVFAPPYHCLQPRLRHQTADFLVIDRYSCVTDGCRNPPVAVSSLISLINIMDMSFQIGIFAFCRLDGQLVIEGAAWQSDNPQQQFNGWHFLNPATSCVLSAALLSRHRAFLGQPLPL

SEQ ID NO: 5491 - DNA, 288 bp, Neisseria gonorrhoeae
atgtcccaaaaagctgccgcagaccaactgaatctgcccgaatgctccgttttgccgcaatggttgcgcctctaccgtttgaatggtattaacggtttaaagcccaaacccaaaggaagaaagcccgtgaaaaaacagtatccgccgcaaacgaaaaaagccgactatctgaaaaccaaggaagaactgtttgcggaattggcttaccttaaagcggaagcggctgtcctaaaaaagctcgatgccttgaaagaagtgcggcagaaagaacgcaactcgtcgcagggt

SEQ ID NO: 5492 - protein, 96 aa, Neisseria gonorrhoeae
MSQKAAADQLNLPECSVLPQWLRLYRLNGINGLKPKPKGRKPVKKQYPPQTKKADYLKTKEELFAELAYLKAEAAVLKKLDALKEVRQKERNSSQG

SEQ ID NO: 5493 - DNA, 225 bp, Neisseria gonorrhoeae
atgccgctttcaccgtgtaatctgtatcttgccacccatttgcgtaccaatgaatcggaaatggaaaaatatagtgaattaacaaaaatcaggacaaggcggcggaccgcaggcagtacaaatggtacggaaccggttcgcccggtgcttcattaccttagggaatcgttccctttgagccggggcggggcaacgccgtaccggtttttgttaattcactatata

SEQ ID NO: 5494 - protein, 75 aa, Neisseria gonorrhoeae
MPLSPCNLYLATHLRTNESEMEKYSELTKIRTRRRTAGSTNGTEPVRPVLHYLRESFPLSRGGATPYRFLLIHYI

SEQ ID NO: 5495 - DNA, 471 bp, Neisseria gonorrhoeae
atggcagctattacaaaatgtctgcatcaggttcacgaaacgcaagtcgaaagcgtcaaacaactgattgcccgttttgaccggctgattgacgaatcggacaaacaaatcgacaaccacacccgcacgcattttgacggcaaagcccaagtggcggagcaaatcaaaggcatcggttcgataacgacggctacgctgatggcgatgctgcccgaattggggcggctgtcgcacaaacggatagcgggtttggtcggcattgccccgcacccgagggagagcggggaaaccaaattcaaaagccgctgcttcggcggaaggtctgcggtgcgtaaggcgctgtatatggctgccgcggcagcgacacgttttgaaccgcttattcgggatttccaccaacgcctgctgtatagcgaattaacaaaaaccggtacggcgttgccccgccccggctcaaagggaacgattccc

SEQ ID NO: 5496 - protein, 157 aa, Neisseria gonorrhoeae
MAAITKCLHQVHETQVESVKQLIARFDRLIDESDKQIDNHTRTHFDGKAQVAEQIKGIGSITTATLMAMLPELGRLSHKRIAGLVGIAPHPRESGETKFKSRCFGGRSAVRKALYMAAAAATRFEPLIRDFHQRLLYSELTKTGTALPRPGSKGTIP

SEQ ID NO: 5497 - DNA, 129 bp, Neisseria gonorrhoeae
ttgtttttaatccactatattctgactgcctcaaagggcaaaaataatgtgagtatgttgaggctgcctctttttgaaatgacaaacaaaatgccgtctgaaacccgatttccggtttcagacggcatt

SEQ ID NO: 5498 - protein, 43 aa, Neisseria gonorrhoeae
LFLIHYILTASKGKNNVSMLRLPLFEMTNKMPSETRFPVSDGI

SEQ ID NO: 5499 - DNA, 141 bp, Neisseria gonorrhoeae
ttgaacatcaaatgccgtctgaaaccggaaatcgggtttcagacggcattttgtttgtcatttcaaaaagaggcagcctcaacatactcacattatttttgccctttgaggcagtcagaatatagtggattaaaaacaaaa

SEQ ID NO: 5500 - protein, 47 aa, Neisseria gonorrhoeae
LNIKCRLKPEIGFQTAFCLSFQKEAASTYSHYFCPLRQSEYSGLKTK

SEQ ID NO: 5501 - DNA, 888 bp, Neisseria gonorrhoeae
atgagcgtattgattaataaagacaccaaagtattggttcaaggttttaccggtaaaaacggtactttccactccgaacaagctctggcttacggcactaaagttgtcggcggcgttaccccaggcaaaggcggtcaaacccacctagacctgcctgtattcaacaccatgaaagaagccgttaaagaaaccggcgctgacgcatccgtgatttacgttcccgctccgtttgtgttggattctatcgttgaagccgttgattcaggcgtaggcttggtcgttgtgattaccgaaggcgttccaactctggacatgctcaaagccaaacgttacttggaaaccaacggcaacggtacccgcttggtcggccctaactgcccgggcgtgattactccgggcgagtgcaaaatcggcattatgccgggccacatccacactccgggccgcatcggtattatttcccgttccggtacattgacttacgaagccgtggcacaaaccaccaacctgggcttgggtcagtcaacctgtatcggtatcggcggcgacccgattcctggtatgaaccaaatcgacgcactgaaactcttccaagaagacccagataccgatgccatcatcatgattggtgaaatcggtggtactgcggaagaagaagcagccgaatacatccaatccaacgtaaccaaacctgttgtcggttacatcgccggtgttaccgctcctaaaggcaaacgcatgggccacgccggtgcgattatctccggcggtaaaggtactgccgaagaaaaattcgccgcgtttgaaaaagccggtatcgcctacacccgcagccctgccgagttgggcacgacgatgctggaagtgttgaaagcaaaaggtttggca

SEQ ID NO: 5502 - protein, 296 aa, Neisseria gonorrhoeae
MSVLINKDTKVLVQGFTGKNGTFHSEQALAYGTKVVGGVTPGKGGQTHLDLPVFNTMKEAVKETGADASVIYVPAPFVLDSIVEAVDSGVGLVVVITEGVPTLDMLKAKRYLETNGNGTRLVGPNCPGVITPGECKIGIMPGHIHTPGRIGIISRSGTLTYEAVAQTTNLGLGQSTCIGIGGDPIPGMNQIDALKLFQEDPDTDAIIMIGEIGGTAEEEAAEYIQSNVTKPVVGYIAGVTAPKGKRMGHAGAIISGGKGTAEEKFAAFEKAGIAYTRSPAELGTTMLEVLKAKGLA

SEQ ID NO: 5503 - DNA, 1218 bp, Neisseria gonorrhoeae
atgggattggccgcagggcgattcctaaaacccactcaccttaaggagaaatccatgaatttacacgagtatcaggctaaagaactgctggctagctacggtttgcccgtacaaggcggtattttggcgcacaacggcgaagaagccgctgcagcttacgacaaattgggcggcaaattcgctgttgtcaaagcacaggtacacgccggcggccgcggtaaagcgggcggcgtaaaagtcgttaaaagccgcgaaaaagccaaagaagtggctgaaagcctgattggcaccaacttggtaacttaccaaaccgatgccaacggccaacctgtcaacagcgttttggtttgcgaagatatgtatcctgttcaaaccgagctgtacttgggcgcagtggttgaccgttctacccgccgcgttacattcatggcttctaccgaaggcggcgtggaaatcgaaaaagttgctgctgaaactccagaaaaaatcttcaaagtaaccgttgatccgctggtcggcctgcaaccttgccaagctcgcgaagttgccttccaactgggcttgaaagacaaacaaatcaacgagttcgccaaactgatgaccggcgcgtacaaagcgtttgtcgaaaacgacttcgccctgtttgaagtcaacccgctggcagttcgcgaaaacggcgcactggcttgcgtggacggcaaaatcggcatcgacagcaacgcgctctaccgcctgccaaaaatcgctgaattgcgcgacaaatctcaagaaaacgaacgtgaactgaaagcttctgaattcgacctgaactatgttgccctggaaggcaaaatcggctgtatggttaacggtgccggtttggcgatggccaccatggacatcatcaaactcaaaggcggccaacctgccaacttcttggacgttggcggcggcgcaaccaaagaccgcgtggttgaagcgttcaaactgattttggaagacaaatccgttaaaggcgtattgatcaacatcttcggcggtatcgtacgttgcgacatgattgcggaagccatcgtggcagccgttaaagaaatcaacgtcaacgttcctgtcgttgttcgtttggaaggcaacaacgccgaactcggcgcgaaaatcctgaacgaatcaggtctgaaactgacttctgcagacggtctgaatgacgcagccgaaaaaattgttgcagccgtaaacgcc

SEQ ID NO: 5504 - protein, 406 aa, Neisseria gonorrhoeae
MGLAAGRFLKPTHLKEKSMNLHEYQAKELLASYGLPVQGGILAHNGEEAAAAYDKLGGKFAVVKAQVHAGGRGKAGGVKVVKSREKAKEVAESLIGTNLVTYQTDANGQPVNSVLVCEDMYPVQTELYLGAVVDRSTRRVTFMASTEGGVEIEKVAAETPEKIFKVTVDPLVGLQPCQAREVAFQLGLKDKQINEFAKLMTGAYKAFVENDFALFEVNPLAVRENGALACVDGKIGIDSNALYRLPKIAELRDKSQENERELKASEFDLNYVALEGKIGCMVNGAGLAMATMDIIKLKGGQPANFLDVGGGATKDRVVEAFKLILEDKSVKGVLINIFGGIVRCDMIAEAIVAAVKEINVNVPVVVRLEGNNAELGAKILNESGLKLTSADGLNDAAEKIVAAVNA

SEQ ID NO: 5505 - DNA, 180 bp, Neisseria gonorrhoeae; identical to SEQ ID NO: 1039

SEQ ID NO: 5506 - protein, 60 aa, Neisseria gonorrhoeae; identical to SEQ ID NO: 1040

SEQ ID NO: 5507 - DNA, 2829 bp, Neisseria gonorrhoeae
atgagtaacacaaccgtagaacaatttgccgccgagctgaaacgccccgtcgaagacctgttgaaacagttgaaagaagccggcgtcagcaaaaacagcggcagcgattccctgacgctggacgacaaacagcttctgaacgcctacctgaccaagaaaaacggcagcaacggcggcaccatcagcatccgccgcaccaaaaccgaagtcagcaccgttgacggcgtaaaagtcgaaacacgcaaacgcggacgcactgtcaacattccttctgccgaagaattggcagcacaagtaaaagccgcccaaacccaagccgcacctgttcagccggagcagacggcagaagacgcggtaaaagcccgagccgaagctgccgcacgcgcagaagcccgtgccaaggcagaagcggaagcggcaaaactgaaagcggcaaaagcaggcaacaaagccaaacctgccgcgcagaaacctaccgaagcaaaagccgaaaccgcacccgttgcggcggaaaccaaacccgccgagcccaaagaaaaagccgtcaagccgaaacacgagcgaaacggcaaaggcaaagatgccaaaaaaccggcgaaacctgccgcacctgccgtgccgcaacccgtggtcagcgcggaagaacaggcgcaacgcgacgaagaggcgcgccgcgccgccgcattgcgcgcccaccaggaagccctgttgaaagagaaacaggaacgccaggcacgtcgcgaagccatgaaacaacaggcagaacaacaggcaaaagccgcacaggaagccaaaaccggcagacagcgtcccgccaaacctgccgagaaaccgcaggcagccgcaccggccgtcgaaaacaaacctgtcaatccggcaaaagcgaaaaaagaagaccgccgcaaccgcgatgacgaaggtcaaggccgcaacgccaaaggcaaaggtgcaaaaggcgggcgtgaccgcaacaatgcccgcaacggcggcgacgagcgcgtacgcggcggcaagaaaggcaaaaaactcaaactcgagccgaaccaacacgccttccaagcaccgaccgaacccgtcgtacacgaggttttggttcccgaaaccattaccgttgccgatttggcgcacaaaatggcggtcaaaggcgtggaaatggtcaaagccctgatgaaaaagggcatgatggttaccatcaaccaatccatcgaccaagacaccgccctgattgtcgtcaaaaaactcggacacatcggcaaacccgccgccgccgacgatcccgaagccttcttgggcgagggcgcggaagcggaggaagccgaagcattgccgcgtccgcccgtcgttaccgtcatgggccacgtcgaccacggcaaaacctcgctgctggactacatccgccgcgccaaagtggtacagggcgaagcgggcggcattacgcagcacatcggcgcgtaccacgtcaaaaccccgcgcggcgtgattaccttcttggacaccccgggccacgaagcctttaccgctatgcgcgcgcgcggcgcgaaagcaaccgatatcgtgattcttgtggtcgccgccgacgacggcgtgatgccgcaaaccatcgaggcaattgcccacgctaaagcggcaggcgttccgattgtggttgccgtcaataaaatcgataaagacactgccaaccccgaacgcatccgtcaggaactgacccaacacgaagtcatccccgacgattggggcggcacggttcaattcatcgacgtttccgcgaaaaaaggaacgaacatcgacgcgctgctcgaagccgtattgctcgaagccgaagtattggaactgaccgcacctgtcgatgcacccgccaaaggcatcatcgtcgaggcgcgtttggacaaagggcgcggcgcggttgccacattgctggttcaaaacggtacgctgaaaaaaggcgacatgctgctggccggtacggcattcggcaaaatccgcgcgatggtcgatgaaaacggcaaatccattaccgaagccggcccgtccatccccgtcgaaatcctcggcttgtccgacgtaccgaatgcgggtgaagacgcgatggtattggcggacgagaaaaaagcgcgcgaaatcgccctcttccgccaaggcaaataccgcgacgtgcgccttgccaaacagcaggcggcgaagctggaaaatatgttcaacaatatgggcgaaacccaggcccaatctttgtcggtcatcatcaaggcagacgttcagggctcttacgaggctttggcgggcagcctgaaaaaactgtccgccgacgaggtgaaagtgaacgtgttgcacagcggcgtgggcggcattaccgaatcggatgtcaaccttgccatcgcttcgggcgcgttcattatcggctttaacgtgcgtgcagatgcctcttcgcgcaaacttgccgaaaatgaaaacgtggaaatccgctactacaacatcatctacgatgccatcgacgacgtgaaggcggcgatgagcggcatgctttctcccgaaaagaaagaacaggttaccggtacggtcgaaatccgtcaggtcatctccgtttccaaggtcggcaacattgcaggctgtatggtcaccgacggcgtggtcaaacgcgattcccatatccgcctcatccgcaacaacgtggtcatccacacgggcgaactggcttcgttgaaacgctataaagacgacgtaaaagaagtccgcatgggcttcgagtgcggtctgatgctcaaaggctacaacgaaatcatggaaggcgaccaactggaatgcttcgacatcgtcgaagttgcccgcaccctg

SEQ ID NO: 5508 - protein, 943 aa, Neisseria gonorrhoeae
MSNTTVEQFAAELKRPVEDLLKQLKEAGVSKNSGSDSLTLDDKQLLNAYLTKKNGSNGGTISIRRTKTEVSTVDGVKVETRKRGRTVNIPSAEELAAQVKAAQTQAAPVQPEQTAEDAVKARAEAAARAEARAKAEAEAAKLKAAKAGNKAKPAAQKPTEAKAETAPVAAETKPAEPKEKAVKPKHERNGKGKDAKKPAKPAAPAVPQPVVSAEEQAQRDEEARRAAALRAHQEALLKEKQERQARREAMKQQAEQQAKAAQEAKTGRQRPAKPAEKPQAAAPAVENKPVNPAKAKKEDRRNRDDEGQGRNAKGKGAKGGRDRNNARNGGDERVRGGKKGKKLKLEPNQHAFQAPTEPVVHEVLVPETITVADLAHKMAVKGVEMVKALMKKGMMVTINQSIDQDTALIVVKKLGHIGKPAAADDPEAFLGEGAEAEEAEALPRPPVVTVMGHVDHGKTSLLDYIRRAKVVQGEAGGITQHIGAYHVKTPRGVITFLDTPGHEAFTAMRARGAKATDIVILVVAADDGVMPQTIEAIAHAKAAGVPIVVAVNKIDKDTANPERIRQELTQHEVIPDDWGGTVQFIDVSAKKGTNIDALLEAVLLEAEVLELTAPVDAPAKGIIVEARLDKGRGAVATLLVQNGTLKKGDMLLAGTAFGKIRAMVDENGKSITEAGPSIPVEILGLSDVPNAGEDAMVLADEKKAREIALFRQGKYRDVRLAKQQAAKLENMFNNMGETQAQSLSVIIKADVQGSYEALAGSLKKLSADEVKVNVLHSGVGGITESDVNLAIASGAFIIGFNVRADASSRKLAENENVEIRYYNIIYDAIDDVKAAMSGMLSPEKKEQVTGTVEIRQVISVSKVGNIAGCMVTDGVVKRDSHIRLIRNNVVIHTGELASLKRYKDDVKEVRMGFECGLMLKGYNEIMEGDQLECFDIVEVARTL

SEQ ID NO: 5509 - DNA, 3777 bp, Neisseria gonorrhoeae
ttgttggcggcgcaaagcgttgaacaaacgcccgaagcgcgcgagggtttgcatttgtttttggtaacgccccgtttgggtacgatttcgccgtgggcttccaaggcgaccaatatcgcggaaaactgcggtttggcaggcatcgaacgcatcgagcgcggtatggcggtgtggctggaaggtgcgcttaccgatgaacagaaacagcaatgggcggcgttgctgcacgaccgcatgaccgaatccgtgctgcccgattttcagacggcatccaaattattccaccatctcaaatccgaaaccttctccaccgtcgatgttttgggcggcggtaaagaggctttggtcaaagccaataccgaaacgggtttggcactctccgccgacgaaatcgattatctggttgaaaactatcaggctttgcagcgcaatccgtccgatgtggagctgatgatgttcgcgcaggcaaacagcgaacactgccgccacaaaatcttcaacgccgatttcatcctcaacggcgaaaaacaaccgaaatccctgttcggcatgatacgcgacacgcacaacgcgcatcccgaaggtacggtcgtcgcctataaagacaattcgtccgtgatcaaaggcgcgaaaatcgagcgtttctatccgaatgcagcggaaaaccaaggctaccgtttccacgaggaagacacccacatcatcatgaaagtggaaacgcacaaccacccgaccgccatcgcgccgtttgcgggcgcggcaacaggcgcgggcggcgaaatccgcgacgaaggtgcgacgggcaaaggttcgcgtccgaaagcgggcttgaccggctttaccgtgtccaacctcaacatccccgacctcaaacagccgtgggaacaagactacggcaagccggaacacatttcctcgccgttggacatcatgattgaaggcccgattggcggtgcggcgttcaacaacgaattcggccgcccgaacctcttgggctacttccgcacctttgaagaaaaatttgacggtcaggttcgcggctaccacaaaccgattatgattgccggcggtttgggcagcattcaggcgcagcagacgcacaaagacgaaatccccgaaggcgcactgctgatccaactgggcggcccgggcatgctcatcggcttgggcggcggtgcggcttcttcgatggataccggtacaaatgatgcgtctttggacttcaactccgtacaacgcggcaaccctgaaatcgaacgccgcgcgcaggaagtcatcgaccgctgctggcagctcggcgaccaaaacccgattatctccatccacgacgtgggcgcgggcggcttgtccaacgctttccctgaattggtcaacgatgccggacgcggcgcggtattcgagctgcgcgaagtgccgttggaagaacacggtttaacgcctttgcaaatctggtgtaacgaatcgcaagagcgttatgtcttgtcgattttggaaaaagatttggacaccttccgcgccatctgcgaacgcgaacgctgcccgtttgccgtagtcggcacggcgaccgacgacggtcatttgaaagtgcgcgacgatttgttctccaacaaccccgtcgatttgccgctgaacgtcttgctcggcaaaccgcccaaaaccacgcgtaccgacaaaacggttacgccgtccaaaaaaccgtttcacgcgggcgatatcgacatcaccgaagccgcctaccgcgttttgcgcctgcctgccgtagccgccaaaaacttcctgattaccatcggcgaccgcagcgtcggcggcatgacccaccgcgaccaaatggtcggcaaataccaaacccccgtagccgactgcgccgttaccatgatgggcttcaacacctatcgcggcgaagcgatgtctatgggcgaaaaaccggccgtcgccctgtttgacgcgcccgcctcgggcagaatgtgcgtcggcgaagccatcaccaacatcgcggcagtcaacatcggcgacatcggcaacatcaaactttccgccaactggatggcggcgtgcggcaacgaaggcgaagacgaaaaactctaccgcaccgtcgaagccgtttctaaagcctgccaggcattggatttgagcattcccgtaggtaaagacagcctgtcgatgaaaaccgtgtggcaggacggcgaagagaaaaaatccgtggtttcgccgttgagcctgattatttccgcgttcgcgcctgttaaagacgtgcgaaaaaccgttacgcccgaattgaaaaacgtcgaaggcagcgtattgctgtttatcgatttgggcttcggcaaagcgcgcatgggcggctcggcgttcggtcaggtgtacaacaacatgagcggcgacgcgcccgatttggacgatgcaggccgtctgaaagcgttttacagcgtaattcaacagcttgtcgccgaagacaaacttttggcgtatcacgaccgcagcgacggcggtttgtttgcgacgctggcggaaatggcgtttgcggcacggtgcggtattagtgccgatatagattgcctgatggataaattcctgccgattcatctcccggattttcaaggcgaccctgccgaagacttatctgacgaactttataatcatgccgccattaaaatcttattcaatgaagaattaggcgcggttatccaaatccgccaaaaagatagggattatgttgatgcggcatttgaaacggccggcttaaccgatgcggtcagccggattggctctcctgattttgacaatgagtttatttctttctttggttacggttatttcttggaacaaaaccgcgccgacctgcaacgcgcgtggcaggaaaccagccacgccatccaacgcctgcgcgacaaccctgcctgcgccgacagcgagttcgccctgattggcgacaacgaacgcagcgcattgtttgccgacgtgaagttcgacgtgaacgaagacatcgccgcgccgtttatcaacagtggcgcgaaacctaaaatcgccatcctgcgcgaacagggcgtaaacgggcaaatcgaaatggccgccgccttcacccgcgccggattcgatgcctacgacgtgcatatgtccgacctgatggctggccgcttccgccttgccgacttcaaaatgctggcggcgtgcggcggcttcagctacggcgacgtactcggcgcgggtgaaggctgggcgaaatccatcctgttccaccctgccttgcgcgaccaattcgccgccttctttgccgatccgaacacgctgacattgggcgtgtgcaacggctgccaaatggtcagcaaccttgccgaaattatcccgggcgcagaaacatggccgaagttcaaacgcaacctgagcgagcagtttgaagcgcgcctgaatatggttcacgtccccaaatcagcgtcgctgattttgaacgaaatgcaagactccagcctgcctgtcgtggtcagccacggcgaaggccgcgccgacttcgcgcttcacggcggcaatatttccgccgatttgggcatcgcgctgcaatatgtggacggtcaaaaccaggttacccaaacctatccgctcaaccccaacggctcgccgcagggcatcgccggcattaccaacgccgacggccgcgttaccattatgatgccccaccccgaacgcgtgtaccgtgccgcacaaatgagccggaaaccggaaggctggacggaactgtccggctggtaccgcctctttgccggcgcacgtaaagccttgggc

SEQ ID NO: 5510 - protein, 1259 aa, Neisseria gonorrhoeae
LLAAQSVEQTPEAREGLHLFLVTPRLGTISPWASKATNIAENCGLAGIERIERGMAVWLEGALTDEQKQQWAALLHDRMTESVLPDFQTASKLFHHLKSETFSTVDVLGGGKEALVKANTETGLALSADEIDYLVENYQALQRNPSDVELMMFAQANSEHCRHKIFNADFILNGEKQPKSLFGMIRDTHNAHPEGTVVAYKDNSSVIKGAKIERFYPNAAENQGYRFHEEDTHIIMKVETHNHPTAIAPFAGAATGAGGEIRDEGATGKGSRPKAGLTGFTVSNLNIPDLKQPWEQDYGKPEHISSPLDIMIEGPIGGAAFNNEFGRPNLLGYFRTFEEKFDGQVRGYHKPIMIAGGLGSIQAQQTHKDEIPEGALLIQLGGPGMLIGLGGGAASSMDTGTNDASLDFNSVQRGNPEIERRAQEVIDRCWQLGDQNPIISIHDVGAGGLSNAFPELVNDAGRGAVFELREVPLEEHGLTPLQIWCNESQERYVLSILEKDLDTFRAICERERCPFAVVGTATDDGHLKVRDDLFSNNPVDLPLNVLLGKPPKTTRTDKTVTPSKKPFHAGDIDITEAAYRVLRLPAVAAKNFLITIGDRSVGGMTHRDQMVGKYQTPVADCAVTMMGFNTYRGEAMSMGEKPAVALFDAPASGRMCVGEAITNIAAVNIGDIGNIKLSANWMAACGNEGEDEKLYRTVEAVSKACQALDLSIPVGKDSLSMKTVWQDGEEKKSVVSPLSLIISAFAPVKDVRKTVTPELKNVEGSVLLFIDLGFGKARMGGSAFGQVYNNMSGDAPDLDDAGRLKAFYSVIQQLVAEDKLLAYHDRSDGGLFATLAEMAFAARCGISADIDCLMDKFLPIHLPDFQGDPAEDLSDELYNHAAIKILFNEELGAVIQIRQKDRDYVDAAFETAGLTDAVSRIGSPDFDNEFISFFGYGYFLEQNRADLQRAWQETSHAIQRLRDNPACADSEFALIGDNERSALFADVKFDVNEDIAAPFINSGAKPKIAILREQGVNGQIEMAAAFTRAGFDAYDVHMSDLMAGRFRLADFKMLAACGGFSYGDVLGAGEGWAKSILFHPALRDQFAAFFADPNTLTLGVCNGCQMVSNLAEIIPGAETWPKFKRNLSEQFEARLNMVHVPKSASLILNEMQDSSLPVVVSHGEGRADFALHGGNISADLGIALQYVDGQNQVTQTYPLNPNGSPQGIAGITNADGRVTIMMPHPERVYRAAQMSRKPEGWTELSGWYRLFAGARKALG

SEQ ID NO: 5511 - DNA, 102 bp, Neisseria gonorrhoeae
tacaggcagaaccctatctttgcacctgcaaaaccaacaaattttgttttgattaatgcaaatatgcacagatgtttttgaaaaaagatggaaatatgtcat

SEQ ID NO: 5512 - protein, 26 aa, Neisseria gonorrhoeae
YRQNPIFAPAKPTNFVLINANMHRCF

SEQ ID NO: 5513 - DNA, 348 bp, Neisseria gonorrhoeae
atgttccgagagcttcgttttctgatttataattccgtcagacaaacagcatttacattcattatgaacaaagaaatagtcggtattttctttataccgatgggcatcatcagcatgtgtatggccgcattgtggcagatgtatgtgatgatgaccgaaacttatacgctcaaccgtttcaaagataaagaattggtttggcgcgtggcattgttgtttatcagtttcagccttgccgtttatctgctctgtccgaattcgcgtaaaaaaggcatcgtcttttttattctcgggggaggcggtgcagtcatgtatctgctggcgcggatgtggttgcccttcagtaaa

SEQ ID NO: 5514 - protein, 116 aa, Neisseria gonorrhoeae
MFRELRFLIYNSVRQTAFTFIMNKEIVGIFFIPMGIISMCMAALWQMYVMMTETYTLNRFKDKELVWRVALLFISFSLAVYLLCPNSRKKGIVFFILGGGGAVMYLLARMWLPFSK

SEQ ID NO: 5515 - DNA, 1431 bp, Neisseria gonorrhoeae
atgtctcaatatgatgtagtagtgattggtgcaggtccgggcggatacgttgccgccatccgtgccgcacaactgggtttcaaaactgcctgtgtcgatgcaggcgttaacaaagcaggcaatgcccctgcattgggcggtacttgcttgaacgtaggctgtatcccttctaaagccctgttgcaatccagcgaacatttccacgctgcgcaacacgattttgccgaacacggtatcactgtcggcgacgtaaaattcgacgcggccaaaatgattgagcgcaaagatgccatcgtgaccaaactgaccggcggcgtgaaattcctgttccaaaaaaacaaagtaaccagcctgttcggtactgcttcctttgccggtaaaaatggcgatgcttaccaaattgaagtcgataacaaaggcgagaaaaccgttatcgaagccaaacacgtcatcgtagcaaccggttccgtaccgcgtccgttgccgcaagtcgctatcgacaacgtgaacgtattggacaacgaaggcgcattgaacctgactgaagtacctgccaaactcggcgtaatcggttccggtgtgattggtttggaaatgggttccgtatggaaccgcgtgggtgcggaagttaccattcttgaagccgcgccgaccttcctggctgccgccgaccaacaaatcgccaaagaagccttcaaatacttcaccaaagagcaaggtctgagcatcgaattgggtgtgaaaatcggcgacatcaagtctgaaggcaaaggtgtttccgttgcttacgaaactgctgccggcgaagccaaaaccgaagtattcgacaaactgatcgttgccatcggccgtattccaaacaccaaaggcctgaacgctgaagccgtaggcttggaaaaagacgagcgcggctttatcaaagtggatggcgaatgccgtaccaacctgcctaacgtatgggcaatcggcgacgtggttcgcggcccgatgttggcacacaaagccagcgacgaaggcgttgccgttgccgagcgcattgccggtcaaaaaccgcatatcgacttcaacaacgtaccgtttgtgatttacaccgaccctgaaatcgcttgggtgggtaaaaccgaagagcagctcaaagccgaaggcgtggagtacaaaaaaggtacttcaggtttcggtgcaaacggccgtgcattggcaatgggcaaagccaaaggtacggttaaagtgttggcagatgccaaaaccgaccgtatcttgggcgtacacatgatcggcccggttgtcagcgaattggttaccgaaggcgtgactgcgctcgaattcttcgccagcagcgaagacatcgcccgtattatccatgcccacccaaccttgtccgaagtggttcacgaagctgcattggcggccgacaaacgcgctttgcacggt

SEQ ID NO: 5516 - protein, 477 aa, Neisseria gonorrhoeae
MSQYDVVVIGAGPGGYVAAIRAAQLGFKTACVDAGVNKAGNAPALGGTCLNVGCIPSKALLQSSEHFHAAQHDFAEHGITVGDVKFDAAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLAAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELVTEGVTALEFFASSEDIARIIHAHPTLSEVVHEAALAADKRALHG

SEQ ID NO: 5517 - DNA, 174 bp, Neisseria gonorrhoeae
ttgaatgactgcgttttgatggttttaagaaaaagccgtctgaaagtccatatctgccgattcattcgaatcaaatgtttcagacggcctcaatcgttcgttgagcctattgtagcacgatactacattacgctacatctaaataaaaattcagacggccttttcattaacaaa

SEQ ID NO: 5518 - protein, 58 aa, Neisseria gonorrhoeae
LNDCVLMVLRKSRLKVHICRFIRIKCFRRPQSFVEPIVARYYITLHLNKNSDGLFINK

SEQ ID NO: 5519 - DNA, 1179 bp, Neisseria gonorrhoeae
atgattattgatgtaaaagtacctatgctgtctgaaagcgtatctgaaggcacactcttggaatggaagaaaaaagttggcgaagcagttgcccgtgacgaaatcctgatcgatatcgaaacggacaaagtggttttggaagtaccttctccacaagccggcgtattggttgaaatcgtagcgcaagacggtgaaaccgttgttgccgaccaagttttggcccgtatcgatacagctgctactgtcgctgctgaagcacctgcagccgctcctgccgaagctgccccggctgccgttcctgctgctgcacaaaacaacgccgccatgcctgccgctgcaaaactggctgccgagaccggtgttgacgtgaacgtattgcaaggttccggccgtgacggtcgcgtattgaaagaagacgtacaaaatgccgctgccaaacctgccgcagccgtggcccctgccgttgcacttcctgccggcgcacgtcctgaagaacgcgtaccaatgagccgcctgcgtgcccgtgttgcagaacgcctcttggcttctcaacaagaaaacgccattctgactacattcaacgaagtcaacatgaaaccgatcatggacttgcgtgcgaagtacaaagaaaaattcgagaaagaacatggcgtaaaactgggctttatgtccttcttcgttaaagccgctgttacagccctgaaaaaatacccggttgtgaatgcttctgttgacggcaaagacattgtgtaccacggctacttcgacatcggtatcgcaattggcagcccacgcggtttggttgtaccaatcctgcgcgatgccgaccaaatgagcattgccgacatcgaacaagcaattgttgattacgcaaaaaaagccaaagacggcaaaatcgctatcgaagacctgaccggcggtacattcagtattaccaacggcggtactttcggttctatgatgtccaccccgatcatcaacccgcctcaatctgcgattttgggtatgcatgccactaaagagcgcgctgtggttgaaaacggccaagttgttgtccgtccaatgatgtatctggctctgtcttacgaccaccgtatcattgacggccgcgaagctgtattgaccttggtagccattaaagacgcgttggaagacccggtccgcctgttgttggatctg

SEQ ID NO: 5520 - protein, 393 aa, Neisseria gonorrhoeae
MIIDVKVPMLSESVSEGTLLEWKKKVGEAVARDEILIDIETDKVVLEVPSPQAGVLVEIVAQDGETVVADQVLARIDTAATVAAEAPAAAPAEAAPAAVPAAAQNNAAMPAAAKLAAETGVDVNVLQGSGRDGRVLKEDVQNAAAKPAAAVAPAVALPAGARPEERVPMSRLRARVAERLLASQQENAILTTFNEVNMKPIMDLRAKYKEKFEKEHGVKLGFMSFFVKAAVTALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPVRLLLDL

SEQ ID NO: 5521 - DNA, 1161 bp, Neisseria gonorrhoeae
gtggtcgtaagacagagccagatacatcattggacggacaacaacttggccgttttcaaccacagcgcgctctttagtggcatgcatacccaaaatcgcagattgaggcgggttgatgatcggggtggacatcatagaaccgaaagtaccgccgttggtaatactgaatgtaccgccggtcaggtcttcgatagcgattttgccgtctttggctttttttgcgtaatcaacaattgcttgttcgatgtcggcaatgctcatttggtcggcatcgcgcaggattggtacaaccaaaccgcgtgggctgccaattgcgataccgatgtcgaagtagccgtggtacacaatgtctttgccgtcaacagaagcattcacaaccgggtattttttcagggctgtaacagcggctttaacgaagaaggacataaagcccagttttacgccatgttctttctcgaatttttctttgtacttcgcacgcaagtccatgatcggtttcatgttgacttcgttgaatgtagtcagaatggcgttttcttgttgagaagccaagaggcgttctgcaacacgggcacgcaggcggctcattggtacgcgttcttcaggacgtgcgccggcaggaagtgcaacggcaggggccacggctgcggcaggtttggcagcggcattttgtacgtcttctttcaatacgcgaccgtcacggccggaaccttgcaatacgttcacgtcaacaccggtctcggcagccagttttgcagcggcaggcatggcggcgttgttttgtgcagcagcaggaacggcagccggggcagcttcggcaggagcggctgcaggtgcttcagcagcgacagtagcagctgtatcgatacgggccaaaacttggtcggcaacaacggtttcaccgtcttgcgctacgatttcaaccaatacgccggcttgtggagaaggtacttccaaaaccactttgtccgtttcgatatcgatcaggatttcgtcacgggcaactgcttcgccaacttttttcttccattccaagagtgtgccttcagatacgctttcagacagcataggtacttttacatcaataatcattttgtgtctccaatggccctttcagacggcctgttgtgtgtttttaattctgcatatgggcattccgcc

SEQ ID NO: 5522 - protein, 387 aa, Neisseria gonorrhoeae
VVVRQSQIHHWTDNNLAVFNHSALFSGMHTQNRRLRRVDDRGGHHRTESTAVGNTECTAGQVFDSDFAVFGFFCVINNCLFDVGNAHLVGIAQDWYNQTAWAANCDTDVEVAVVHNVFAVNRSIHNRVFFQGCNSGFNEEGHKAQFYAMFFLEFFFVLRTQVHDRFHVDFVECSQNGVFLLRSQEAFCNTGTQAAHWYAFFRTCAGRKCNGRGHGCGRFGSGILYVFFQYATVTAGTLQYVHVNTGLGSQFCSGRHGGVVLCSSRNGSRGSFGRSGCRCFSSDSSSCIDTGQNLVGNNGFTVLRYDFNQYAGLWRRYFQNHFVRFDIDQDFVTGNCFANFFLPFQECAFRYAFRQHRYFYINNHFVSPMALSDGLLCVFNSAYGHSA

SEQ ID NO: 5523 - DNA, 2910 bp, Neisseria gonorrhoeae
atgtcttttcagacggcatcagttcagccgtcaggacgcggacttctaccctttgtttatattttaaagaaaagagcgcacgccatgatggacgaaaaactcaatttctcttatctgttcggttcgaacgcaccctacattgaggaattgtacgaggcttttttggaaaaccccgatgcggttgatgaaaaatggaagcagtatttcaccgatttgagcaaacagccggggacggttgctgtcgatgtcgcacacacaccgattcgcgaatcatttgttactttggcgaaaaagaaaattgcatctgccgttgcgggcggtgcggatgaggcaatgctgaaaaagcaagtcagcgttttacggctgatttctgcctatcgtatccaaggcgtgggtgcggcccaacttgatccgctcaaacgtatccctccgcgcgatattgaagccctcgatccgaaattccacggtctgtcagatgccgatatggcgcttcgattcaatatgggcgagggtgattttgccaatcgcggcaaactgctcttgtcccaaatcatcagcaacctcaaacaaacctactgcggccacatcgcattggaatatatctatattcccaataccgaagagcgccgttgggtacgcaactattttgaaagcgtattgtccacaccgcattacaatgccgatcaaaaacgccgtatcttgaaagagatgaccgctgccgagactttggaacgttatctgcataccaaatatgtcggtcagaaacgtttcggtgtcgaaggcggcgaaagcgcgattgccggtttgaactacctgattcaaaacgccggtaaggacggcgtggaagaagtcatcatcggtatggcgcaccgtggccgtctgaatgttttggtgaacattttgggcaaaaaacccggcgatttgtttgccgaatttgaaggccgtgccgaaatcaaactgcctagtggcgacgtgaaataccatatgggcttcagctccgatattgccacccctcacggcccgatgcacgtttctttggcgttcaacccgtcacacttggaaatcgtcaatccggtagtggaaggttctgcacgcgccaaacaaaaacgtttgggcgaaaacggccgcgataaagtcttgccggtattgattcacggcgattccgcatttatcggtttgggtgtcaaccaagcaacattcaacctgtctaaaacgcgcggttataccacaggcggtacggtccatatcgtcatcaacaaccaaatcggctttaccacttccgatatccgcgatacccgttcaaccgtacactgtaccgatatcgcaaaaatggtttccgctccggttatccatgtgaacggcgatgatcccgaacgcgtttgctttgccattcaagccgctttggattaccgcaaaaaattccataaagacatcgtaatcgacgttgtctgctaccgtaaatggggtcacaacgagggcgatgatccgactttgacccaaccgatgatgtacaaaaaagtatcgcaacatccgggtgcgcgtgctttgtacaccgagcaactgattgccgaaggcgtggtaactcaagttgaggccgacggttacatccaagcctaccgtgatgctttggacaaaggcgaacatgttgagcaaacaacgttgagcaacttccaacgcacacaaatcgactggagcaaataccaaggtaaagattggcgcgaaaaaatcgaaaccggtttgcctgccgccgacattgagcgtcttactgagaaattcaccgctgtgccggaaggctttgccctgcatccgactgcaaaacgtgtgatcgaagcgcgtaaagccatggcatccggcaaacaagccatcgactggggtatggccgaaaccctcgcatacgcaagcctgctgaccaaaggtcatggcgtgcgtatctccggtgaggactccggccgcggtacattctcacaccgtcatgccgttctgcacgatcaaaaacgcgaaaaatgggacgacggtacttatgttcctcttcgcaacatgggcgaaggcttgggcgagttcctggttatcgactctatcttgaacgaagaagccgtgatggcgttcgagtacggctttgcctgctccgctcctgacaagctgaccatttgggaagctcaattcggtgacttcgccaacggcgcgcaagtaactattgatcaattcctgtcttcaggcgaaaccaagtggggtcgcttgtgcggtctgaccaccatcctgccgcacggctacgacggtcaaggccctgaacactcttctgcacgcgtagaacgttggttgcaactgtgttctgagaacaatatgcaagtcatcatgccgtctgaagcgtcgcaaatgttccatctcttgcaacgccaagtcttgggttcataccgcaaaccgctggtgattttcatgtccaaacgcctgttgcgcttcaaaggtgcaatgagcccgctggaaaacttcaccgaaggttcgactttccgtccggttattggtgataccgccgaacgcgcaagcaacgacagcgtgaaacgcgtggtattgtgtgccggtcaggtttactatgacttggaagccggtcgagccgaacgtaaactggaagatgatgtcgctatcgtccgcgttgagcagctgtatccgttcccatacgacgaggttaaagccgaactggcgaaatatccgaacgcaaaatctgtggtttgggcgcaagaagagccgaaaaaccaaggcgcgttctaccaaatccgccaccgcatcgaagacgttatcagcgaagagcaaaaactgtcttatgccggccgtccaagcagcgcatcgcctgcagtgggctactcaagcaaacacattgctcaattgaaacaattggttgaagacgctttggcgtta

SEQ ID NO: 5524 - protein, 970 aa, Neisseria gonorrhoeae
MSFQTASVQPSGRGLLPFVYILKKRAHAMMDEKLNFSYLFGSNAPYIEELYEAFLENPDAVDEKWKQYFTDLSKQPGTVAVDVAHTPIRESFVTLAKKKIASAVAGGADEAMLKKQVSVLRLISAYRIQGVGAAQLDPLKRIPPRDIEALDPKFHGLSDADMALRFNMGEGDFANRGKLLLSQIISNLKQTYCGHIALEYIYIPNTEERRWVRNYFESVLSTPHYNADQKRRILKEMTAAETLERYLHTKYVGQKRFGVEGGESAIAGLNYLIQNAGKDGVEEVIIGMAHRGRLNVLVNILGKKPGDLFAEFEGRAEIKLPSGDVKYHMGFSSDIATPHGPMHVSLAFNPSHLEIVNPVVEGSARAKQKRLGENGRDKVLPVLIHGDSAFIGLGVNQATFNLSKTRGYTTGGTVHIVINNQIGFTTSDIRDTRSTVHCTDIAKMVSAPVIHVNGDDPERVCFAIQAALDYRKKFHKDIVIDVVCYRKWGHNEGDDPTLTQPMMYKKVSQHPGARALYTEQLIAEGVVTQVEADGYIQAYRDALDKGEHVEQTTLSNFQRTQIDWSKYQGKDWREKIETGLPAADIERLTEKFTAVPEGFALHPTAKRVIEARKAMASGKQAIDWGMAETLAYASLLTKGHGVRISGEDSGRGTFSHRHAVLHDQKREKWDDGTYVPLRNMGEGLGEFLVIDSILNEEAVMAFEYGFACSAPDKLTIWEAQFGDFANGAQVTIDQFLSSGETKWGRLCGLTTILPHGYDGQGPEHSSARVERWLQLCSENNMQVIMPSEASQMFHLLQRQVLGSYRKPLVIFMSKRLLRFKGAMSPLENFTEGSTFRPVIGDTAERASNDSVKRVVLCAGQVYYDLEAGRAERKLEDDVAIVRVEQLYPFPYDEVKAELAKYPNAKSVVWAQEEPKNQGAFYQIRHRIEDVISEEQKLSYAGRPSSASPAVGYSSKHIAQLKQLVEDALAL

SEQ ID NO: 5525 - DNA, 1311 bp, Neisseria gonorrhoeae
gtgggttataacttgcaaaggagcgataatatgtccaaatcaatcaaactcaacgtaccgggtcgggcaggtttggagctgccggtattggaagccagcatcgggcatgatgtggttgacattcgggggctgacaaaaaatacaggtttgtttgccttcgaccccggatttgtttcaaccgcaagctgtgagtctaaaattacttacatcgacggcgatcaaggcttgctttattatcgcggataccccatcgagcagctggccgaaaagtccgattatttggaagtctgctacctgttgatttacggcgaactgccgactcccgagcaaaaggcagaatttgacaatacagtccgccgccacacgatggtgcatgaacagctgacttggttcttccggggtttccgccgcgacgcgcatccgatggcgatgatggtcggcgtggtcggcgcgctgtctgcgttctaccaagacagcttggacattactaatcccgaacaccgcaaaatcgcgatttaccgccttatttccaaaatcccgaccattgcggcaatgtgttaccgctattcaaacggtctgccgttcaattatccgaagaataatctttcttattcagaaaacttccttcatatgatgtttgccacaccgtgtgaagactacaaacctaatcccgttttggcacgcgcgctcgaccgcatctttattttgcatgccgaccacgagcaaaacgcctcaacttcaaccgtccgtctggcaggctcttcgggtgcgaacccgtttgcctgtattgctgccggtatcgcctgcctgtggggtgcttcgcacggcggtgcgaacgaagccgtgttgaaaatgctggatgaaatcggcgatgtgtccaatgttgccgcatacatggaaggcgtgaaacagcgcaaataccgcctgatgggcttcggacaccgggtataccgcaatatggatccgcgtgccagcattatgcgcgaaacctgctatgaagttttgaaggaattgggcttggaagacagtccgaaattcaaactggcgatggaattggaacagattgcgctgaaagacccgttctttatcgaacgcaaactgtatcccaatgtcgatttctattccggcatcgtcctgtccgcgctgggcatcccgaccgaaatgtttaccgtcatcttcgccctgtcgcgcagcgtgggctggatttcgcactggcacgagatgattagcgatccttcgctgaaaatcggccgcccgcgccagctttataccggttcggaacgccgcgattatgtgccggcaggcgagagg

SEQ ID NO: 5526 - protein, 437 aa, Neisseria gonorrhoeae
VGYNLQRSDNMSKSIKLNVPGRAGLELPVLEASIGHDVVDIRGLTKNTGLFAFDPGFVSTASCESKITYIDGDQGLLYYRGYPIEQLAEKSDYLEVCYLLIYGELPTPEQKAEFDNTVRRHTMVHEQLTWFFRGFRRDAHPMAMMVGVVGALSAFYQDSLDITNPEHRKIAIYRLISKIPTIAAMCYRYSNGLPFNYPKNNLSYSENFLHMMFATPCEDYKPNPVLARALDRIFILHADHEQNASTSTVRLAGSSGANPFACIAAGIACLWGASHGGANEAVLKMLDEIGDVSNVAAYMEGVKQRKYRLMGFGHRVYRNMDPRASIMRETCYEVLKELGLEDSPKFKLAMELEQIALKDPFFIERKLYPNVDFYSGIVLSALGIPTEMFTVIFALSRSVGWISHWHEMISDPSLKIGRPRQLYTGSERRDYVPAGER

SEQ ID NO: 5527 - DNA, 273 bp, Neisseria gonorrhoeae
ttgcaagttataacccacgttactgcatccgcagcacgttctttgctttcagacggcctttgcattttgaaatctgccctcagacaaatttcagatgcctcatgcccgtctgattttttcaagcatcgggataaggtgccctttgtccgtttccgaatgcccgtgaatcaaggcaagcaattcttgatcttgaaattcaaggatttcggaaaactcggacagctctttatcgctcaaatgctcgaattctttttccataaacctgccgaagat

SEQ ID NO: 5528 - protein, 91 aa, Neisseria gonorrhoeae
LQVITHVTASAARSLLSDGLCILKSALRQISDASCPSDFFKHRDKVPFVRFRMPVNQGKQFLILKFKDFGKLGQLFIAQMLEFFFHKPAED

SEQ ID NO: 5529 - DNA, 699 bp, Neisseria gonorrhoeae; identical to SEQ ID NO: 11

SEQ ID NO: 5530 - protein, 233 aa, Neisseria gonorrhoeae; identical to SEQ ID NO: 12

SEQ ID NO: 5531 - DNA, 648 bp, Neisseria gonorrhoeae; identical to SEQ ID NO: 1283

SEQ ID NO: 5532 - protein, 216 aa, Neisseria gonorrhoeae; identical to SEQ ID NO: 1284

SEQ ID NO: 5533 - DNA, 246 bp, Neisseria gonorrhoeae
atgatggtttttgacgacattgccaaacggaaaatccgttttcaaacccgccggggattgttggaactagatttaatcttcggcaggtttatggaaaaagaattcgagcatttgagcgataaagagctgtccgagttttccgaaatccttgaatttcaagatcaagaattgcttgccttgattcacgggcattcggaaacggacaaagggcaccttatcccgatgcttgaaaaaatcagacgggca

SEQ ID NO: 5534 - protein, 82 aa, Neisseria gonorrhoeae
MMVFDDIAKRKIRFQTRRGLLELDLIFGRFMEKEFEHLSDKELSEFSEILEFQDQELLALIHGHSETDKGHLIPMLEKIRRA

SEQ ID NO: 5535 - DNA, 174 bp, Neisseria gonorrhoeae
gtgtttaggacatacgtctacgcagttcataatggtgtggcagcggaacaaacggtacggatcgttcaaattatccaaacgctcattagtgatggtatctcggctgtccgcaatgaagcggtaggcgttcagcaagccggacggaccgacgaatttgtcgggattccaccagaa

SEQ ID NO: 5536 - protein, 58 aa, Neisseria gonorrhoeae
VFRTYVYAVHNGVAAEQTVRIVQIIQTLISDGISAVRNEAVGVQQAGRTDEFVGIPPE

SEQ ID NO: 5537 - DNA, 729 bp, Neisseria gonorrhoeae
ttgatgagaaaaggaacacttctcatggaaaaaatgagttttgaaatttaccgttacaacccggacgttgatgccaagccttatatgcagcgttacgagttggaattggaaccgaccgacgtgaaacttttggacgctttggtacgcctgaaagcacaagacgataccttgtctttccgccgctcctgccgcgaagggatttgcggatcggacggtatgaacatcaacggcaaaaacggcttggcgtgtctgaccgatttacgcagcttgaaacagcctgtcaaaatccgcccgctgcccggtctgcccgtcatccgcgacctgattgtggatatgacccagttcttcaaacaataccattccgtcaaaccttatgttgttaacgacaatccgattgatgcggacaaagagcgtctgcaaactcaggaagagcgcaaagagttggatggtttgtacgaatgtattttgtgcgcctgctgttcgaccgcctgtccgtcattctggtggaatcccgacaaattcgtcggtccgtccggcttgctgaacgcctaccgcttcattgcggacagccgagataccatcactaatgagcgtttggataatttgaacgatccgtaccgtttgttccgctgccacaccattatgaactgcgtagacgtatgtcctaaacacttgaatccgacccgagccatcggtaagattaaagagattatgttgaaacgggttgtt

SEQ ID NO: 5538 - protein, 243 aa, Neisseria gonorrhoeae
LMRKGTLLMEKMSFEIYRYNPDVDAKPYMQRYELELEPTDVKLLDALVRLKAQDDTLSFRRSCREGICGSDGMNINGKNGLACLTDLRSLKQPVKIRPLPGLPVIRDLIVDMTQFFKQYHSVKPYVVNDNPIDADKERLQTQEERKELDGLYECILCACCSTACPSFWWNPDKFVGPSGLLNAYRFIADSRDTITNERLDNLNDPYRLFRCHTIMNCVDVCPKHLNPTRAIGKIKEIMLKRVV

SEQ ID NO: 5539 - DNA, 1671 bp, Neisseria gonorrhoeae
ttgaattgtgccgttttgtctaaagtgttcccgacccgctcgcataccgtagcggcgcagggcggtatttccgcctctctgggtaatgtgcaggaggaccgttgggactggcacatgtacgataccgtgaaaggttccgactggctgggcgaccaagatgcgattgagtttatgtgtcgcgctgcgcctgaagcggtgattgagttggaacacatgggtatgccttttgaccgcgttgaaagcggcaaaatttatcagcgtcctttcggcggacatactgccgaacatggtaaacgtgcggtagaacgtgcatgtgcggttgccgaccgtaccggtcatgcgatgttgcatactttgtaccaacaaaacgtccgtgccaatacacaattctttgtggaatggacggcgcaagatttgattcgtgatgaaaacggcgatgtcgtcggcgtaaccgccatggaaatggaaacgggcgaagtttatattttccacgccaaggccgtgatgtttgctaccggtggcggcggtcgtatttatgcttcttctaccaatgcttatatgaataccggtgacggtttgggcatttgcgcccgtgcgggcattccgttggaagatatggaattctggcaattccacccgaccggcgtggcgggtgcgggcgtgttgattaccgaaggcgtacgcggcgagggcggtattctgttgaacgccgacggcgaacgctttatggaacgctatgcgccgaccgtaaaagacttggcttctcgcgacgtggtttcacgcgcgatggcgatggaaatctatgaaggtcgcggctgtggtaaaaacaaagaccacgtcttactgaaaatcgaccatatcggtgcagaaaaaattatggaaaaactgccgggcatccgcgagatttccattcagtttgccggtatcgatccgattaaagacccgattccggttgtgccgactacccactatatgatgggcggcattccgaccaattatcacggtgaagttgttgttccgcaaggcgacgagtacgaagtacctgtaaaaggcctgtatgccgcaggtgagtgcgcctgtgcttccgtacacggtgcgaaccgtttgggtacgaactccctgctggacttggtggtgttcggcaaagctgccggtgacagcatgattaaattcatcaaagagcaaagcgattggaaacctctgcctgctaatgccggtgagttgacccgccaacgtatcgagcgtttggacagtcaaaccgatggtgaaaacgttgatgcattgcgtcgcgaactgcaacgctccgtacaactgcacgccggcgtgttccgtaccgatgagattctgagcaaaggcgttcaagaaatcatggcgattgccgagcgtgtgaaacgtaccgaaatcaaagacaagagcaaagtgtggaataccgcgcgtatcgaagctttggaattggataacctgattgaagtggcgaaagcgactttggtgtctgccgaagcacgtaaagaatcacgcggtgcgcacgcttcagacgaccatcctgagcgcgatgacgaaaattggatgaaacacaccctgtatcattcggacaccaataccttgtcttacaaaccggtacacaccaagcctttgagcgtggaatacatcaaaccggccaaacgcgtttat

SEQ ID NO: 5540 - protein, 557 aa, Neisseria gonorrhoeae
LNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFGKAAGDSMIKFIKEQSDWKPLPANAGELTRQRIERLDSQTDGENVDALRRELQRSVQLHAGVFRTDEILSKGVQEIMAIAERVKRTEIKDKSKVWNTARIEALELDNLIEVAKATLVSAEARKESRGAHASDDHPERDDENWMKHTLYHSDTNTLSYKPVHTKPLSVEYIKPAKRVY

SEQ ID NO: 5541 - DNA, 339 bp, Neisseria gonorrhoeae
atggtagaacgtaaattgaccggtgcccattacggtttgcgcgattgggtaatgcagcgtgcgactgcggttattatgttgatttataccgttgcacttttagtggttctatttgccctgcctaaagaatatccggcatggcaggcattttttagtcaagcttgggtaaaagtatttacccaagtgagctttatcgccgtattcttgcacgcttgggtgggtatccgcgatttgtggatggactatatcaaacccttcggcgtgcgtttgtttttgcaggttgccaccattgtctggctggtcggctgcctcgtgtattcagttaaagtgatttggggg

SEQ ID NO: 5542 - protein, 113 aa, Neisseria gonorrhoeae
MVERKLTGAHYGLRDWVMQRATAVIMLIYTVALLVVLFALPKEYPAWQAFFSQAWVKVFTQVSFIAVFLHAWVGIRDLWMDYIKPFGVRLFLQVATIVWLVGCLVYSVKVIWG

SEQ ID NO: 5543 - DNA, 423 bp, Neisseria gonorrhoeae
atgggtttacggtttttgagtcgatatataactacagaggaattgactatgtctgtcaaactgcgtcctgtttatctggatttgccgaacatccgtctgccgatacccgggatagtttccatccttcaccgcattagcggggtcgggctgtttattatgctgcctttcctgctgtattttctgtccggtaccctgagtcaagagtctgcatttgaaacttaccgtgccattgtttcccatcctttggtcaagctggttttaatcggtatattgtgggcttatctgcaccattctctcgccggtatccgctttttatttttggatgcgcacaaaggccttgagctgaatactgcgcgcaataccgctaaagccgtatttgcttctgcattggttttgactgtcgttttgggagcgttgttatgg

SEQ ID NO: 5544 - protein, 141 aa, Neisseria gonorrhoeae
MGLRFLSRYITTEELTMSVKLRPVYLDLPNIRLPIPGIVSILHRISGVGLFIMLPFLLYFLSGTLSQESAFETYRAIVSHPLVKLVLIGILWAYLHHSLAGIRFLFLDAHKGLELNTARNTAKAVFASALVLTVVLGALLW

SEQ ID NO: 5545 - DNA, 207 bp, Neisseria gonorrhoeae
atgccgcctgaaatttttttcagacggcattttatttttggggatggggttgggggtcggatgctgataccgtgtcgggaagggagcggcaaaactaaaaatctttcttttaatctgctgtttccacgcgtgtttgtcaaaatctatcagtttgtttttaaaatacactgttcaaaatgggataaaacaggtaaattaacgttgatg

SEQ ID NO: 5546 - protein, 69 aa, Neisseria gonorrhoeae
MPPEIFFRRHFIFGDGVGGRMLIPCREGSGKTKNLSFNLLFPRVFVKIYQFVFKIHCSKWDKTGKLTLM

SEQ ID NO: 5547 - DNA, 381 bp, Neisseria gonorrhoeae; identical to SEQ ID NO: 1319

SEQ ID NO: 5548 - protein, 127 aa, Neisseria gonorrhoeae; identical to SEQ ID NO: 1320

SEQ ID NO: 5549 - DNA, 96 bp, Neisseria gonorrhoeae
aaaaaacctaaaatccgtcattcccgcgcaggcgggaatccaatccgtccggtttccgttttttttttgaatttcaggtaacttccaaaccgccat

SEQ ID NO: 5550 - protein, 26 aa, Neisseria gonorrhoeae
KKPKIRHSRAGGNPIRPVSVFFLNFR

SEQ ID NO: 5551 - DNA, 1401 bp, Neisseria gonorrhoeae
atgaaaaaaattcaagcggatatcgtcgtaatcggcggcggtactgccggtatgggtgcgtttcgcaatgcccgtttacattcggataatgtttacctgattgaaaacaatgtgttcggcacaacctgcgcgcgcgtgggctgtatgccttccaaactcttgattgccgccgcagaagcgcgtcaccacgcattgcataccgaccccttcggcgtgcatttggacaaagacagcatcgtcgtcaacggagaagaggttatgcggcgcgtcaaatccgagcgcgaccgttttgtcggctttgtcgttaccgatgtggaagaatggcctgccgacaagcgcatcatgggctcggctaaattcatcgacgagcataccgtccaaatcgacgaccatatccaaattgcggcaaaaagtttcgtgattgctaccggttcgcgtcccgtcatcctgccgcagtggcagtctttgggcgaccgtttgattatcaacgacgacgttttctcgtgggatacgctgcctaagcgcgttgccgtgttcgggccgggcgttatcggtttggaactgggtcaggcattgcaccgtttgggtgtgaaagttgaaattttcggtttgggcggaatcatcggcggcatttccgaccccgttgtttcagacgaggcgaaagccgtgttcggagaagaattgaaactgcatctggatgctaaaaccgaggtcaaactcgacgcagacggcaatgtagaagtccattgggagcaggatggcgaaaaaggcgtatttgttgccgaatatatgttggcagccgtaggtcgccgtccgaacgttgacaatatcggtttggaaaacatcaatatcgacaaagacgcgcgcggcgtacccgttgccgatccgctgaccatgcagaccagcattccgcatatctttattgcgggcgacgcgtccaaccaactgcccctgctgcatgaagccgccgaccaaggtaagattgccggcgataacgcgggccgctacccgaatatcggcagcggtttgcgccgcagcaccattggcgtggtgtttaccagtccgcaaatcggctttgtcggtttgaaatacgcgcaggttgccgcgcaataccaagccgacgaatttgtcatcggcgaagtatcgttcaaaaatcaaggtcgcagccgcgtgatgctggtaaacaaaggccatatgcgcctgtatgccgaaaaagccaccggccgctttatcggcgcggaaatcgtaggccctgccgccgaacatttggctcacttgttggcatgggcgcatcaaatgaagatgaccgttccgcaaatgctggatatgccgttctaccatcctgttatcgaggaaggtctgcgtaccgcgttgcgcgatgccgatgcgaaattgaaagcc

SEQ ID NO: 5552 - protein, 467 aa, Neisseria gonorrhoeae
MKKIQADIVVIGGGTAGMGAFRNARLHSDNVYLIENNVFGTTCARVGCMPSKLLIAAAEARHHALHTDPFGVHLDKDSIVVNGEEVMRRVKSERDRFVGFVVTDVEEWPADKRIMGSAKFIDEHTVQIDDHIQIAAKSFVIATGSRPVILPQWQSLGDRLIINDDVFSWDTLPKRVAVFGPGVIGLELGQALHRLGVKVEIFGLGGIIGGISDPVVSDEAKAVFGEELKLHLDAKTEVKLDADGNVEVHWEQDGEKGVFVAEYMLAAVGRRPNVDNIGLENINIDKDARGVPVADPLTMQTSIPHIFIAGDASNQLPLLHEAADQGKIAGDNAGRYPNIGSGLRRSTIGVVFTSPQIGFVGLKYAQVAAQYQADEFVIGEVSFKNQGRSRVMLVNKGHMRLYAEKATGRFIGAEIVGPAAEHLAHLLAWAHQMKMTVPQMLDMPFYHPVIEEGLRTALRDADAKLKA

SEQ ID NO: 5553 - DNA, 93 bp, Neisseria gonorrhoeae
atgtttttgattgggaagatatttaaatgctgtctgaaaccgatatgttctgtgtcggcaatgtttcagacgaaaacggaaggacaaagatta

SEQ ID NO: 5554 - protein, 31 aa, Neisseria gonorrhoeae
MFLIGKIFKCCLKPICSVSAMFQTKTEGQRL

SEQ ID NO: 5555 - DNA, 801 bp, Neisseria gonorrhoeae
ttgcatggggtagaatgcgcggcgattcacaattatttctcaaaccaatctattaaggagctcaaaatggctttgcaagatcgtaccggtcaaaaagtaccttccgtagtattccgcacccgcgtcggcgacacttggaaagatgtgtctaccgatgatttgttcaaaggcaaaaaagtagtcgtattctccctgcccggtgcatttaccccgacttgttcttcttcacacctgccgcgttacaacgaattgttcggcgcgttcaaagaaaacggcgttgacgcaatctgctgcgtatctgtaaacgatactttcgtaatgaacgcttgggctgccgaagaagaatcagacaacatctacatgattcctgacggcaacggcgaatttaccgaaggtatgggtatgctggtcggtaaagaagacttgggcttcggcaaacgctcttggcgttactccatgctggttaacgacggcgtggttgaaaaaatgttcatcgaacctgaagaaccgggcgatcctttcaaagtatccgatgcagatactatgctgaaattcgttgctcccgattggaaggctcaagagtctgtggcaattttcactaaaccaggttgccaattctgtgccaaagtcaaacaagctttgcaagacaaaggtttgtcttacgaagaaatcgtattgggcaaagatgcaaccgttacttccgttcgcgctattaccggcaagatgactgcccctcaagtcttcatcggcggcaaatacatcggcggcagcgaagatttggaagcttacttggctaaaaac

SEQ ID NO: 5556 - protein, 267 aa, Neisseria gonorrhoeae
LHGVECAAIHNYFSNQSIKELKMALQDRTGQKVPSVVFRTRVGDTWKDVSTDDLFKGKKVVVFSLPGAFTPTCSSSHLPRYNELFGAFKENGVDAICCVSVNDTFVMNAWAAEEESDNIYMIPDGNGEFTEGMGMLVGKEDLGFGKRSWRYSMLVNDGVVEKMFIEPEEPGDPFKVSDADTMLKFVAPDWKAQESVAIFTKPGCQFCAKVKQALQDKGLSYEEIVLGKDATVTSVRAITGKMTAPQVFIGGKYIGGSEDLEAYLAKN

SEQ ID NO: 5557 - DNA, 144 bp, Neisseria gonorrhoeae
ttgccggaaaatcttttcattgcagcttgtttttctctaattcggctttatatgtggggaacaggcaaatcggagttgtatttgatagttttaaataatttatattatttaaactataaattatacaaatcattttgcatgggg

SEQ ID NO: 5558 - protein, 48 aa, Neisseria gonorrhoeae
LPENLFIAACFSLIRLYMWGTGKSELYLIVLNNLYYLNYKLYKSFCMG

SEQ ID NO: 5559 - DNA, 162 bp, Neisseria gonorrhoeae
atgaacaaatgccgtctgaaagcctttcagacggcattttgtcctgagttgcggcgcaggggagcagttgccggaaaatcttttcattgcagcttgtttttctctaattcggctttatatgtggggaacaggcaaatcggagttgtatttgatagttttaaa

SEQ ID NO: 5560 - protein, 54 aa, Neisseria gonorrhoeae
MNKCRLKAFQTAFCPELRRRGAVAGKSFHCSLFFSNSALYVGNRQIGVVFDSFK

SEQ ID NO: 5561 - DNA, 2313 bp, Neisseria gonorrhoeae
ttgaaccggtccttacaaaatccaactggagagttcaacatgacaacattacatttctcaggcttcccgcgtgtcggcgccttccgtgaattgaaattcgcccaagaaaaatactggcgcaaagagatcagtgaacaagagctgctcgacgttgccaaagacctgcgcgagaaaaactggaaacaccaagctgctgccaacgctgattacgttgctgtaggtgatttcactttctacgatcacatcctcgacctgcaagttgccaccggcgcgattcccgcccgtttcggcttcgatagccaaaacctgcctttggaacaattcttccaactggcgcgcggcaacaaagaccaattcgccatcgaaatgaccaaatggttcgacaccaactaccactacctggtgcctgaattccatgccgataccgaattcaaagccaacgccaaacactacgttcaacaactgcaagaagcccaaactttgggcttgaaagccaaaccgaccgttgtcggtcctttgactttcctgtgggtgggtaaagaaaaaggctccgttgaattcgaccgtctgagcctgttgcctaaactgttgcctgtttacgttgaaatcctgactgctttggttgaagccggtgccgagtggattcaaatcgacgagcctgctttggctgtcgatctgcctaaagaatgggtagaagcatacaaagacgtttacgctactttgaacaaagtaagcgccaaaatcctgttgggcacttacttcggttctgttgccgaacacgccgcattgttgaaatccctgcctgttgacggcctgcacatcgacttggtacgcgcacccgagcaactggacgcgttcgccggctacgacaaagtcctgtctgccggcgtgattgacggccgcaacatttggcgcgccaacctgaacaaagttttggaaaccgtcgggcctctgcaagccaaactgggcgagcgtttgtggatttccagctcttgctcgctgctgcacactccgtttgacttgtcagtcgaagaaaaactgaaagccaacaaacccgacctgtactcttggttggcattcactctgcaaaaaacccaagaattgcgtgttctgaaagccgcattgaatgaaggccgtgattctgttgccgaagaactggccgccagccaagctgctgccgactcccgtgccaacagcagtgaaatccaccgtgcagacgttgccaaacgcttggccgacctgcctgtcaacgcaggccaacgcaaatcaccgtttgccgaccgtatcaaagcgcaacaagcatggttgaacctgcctctgctgccgacgaccaacattggttctttcccgcaaactaccgaaatccgccaagcacgcgcagccttcaaaaaaggcgaactgtctgcctccgattacgaagccgcaatgaaaaaagaaatcgccttggtggttgaagagcaagaaaaactggacttggacgtactggtgcacggcgaagccgagcgtaacgacatggtcgaatacttcggcgaactgttgagcggttttgcattcacccaatacggctgggtgcaaagctacggctcacgctgcgttaaaccacctatcatcttcggtgacgtaagccgtcctgaagctatgactgtcgcttggtctacttacgcacaaaacctgaccaaacgcccgatgaaaggtatgttgaccggtcctgtaaccattctgcaatggtctttcgtccgcaacgatattccgcgcgctaccgtgtgcaaacaaatcgcactggctctgaacgacgaagtattggatctggaaaaagccggcattaaagtcatccaaattgacgaacctgccatccgcgaaggtcttcctttgaaacgtgccgattgggatgcctacctgaactgggcgggcgaatccttccgcctatcctctgcaggttgcgaagacagcactcaaatccacactcatatgtgctactctgagttcaacgacatcctgcctgcgattgctgcaatggatgcggacgtgatcaccattgagacttcacgttccgacatggaactcttggctgcgttcggcgaattcaaatacccgaacgacatcggcccgggcgtttacgacatccacagcccgcgcgtaccgacagaagccgaagtggaacacctgttgcgcaaagccattgaggttgttccggttgagcgtctgtgggttaacccggactgcggcctgaaaacacgcggctggaaagaaactctggaacagcttcaagtaatgatgaacgtaacccgcaaactgcgtgccgaattggcgaaa

SEQ ID NO: 5562 - protein, 771 aa, Neisseria gonorrhoeae
LNRSLQNPTGEFNMTTLHFSGFPRVGAFRELKFAQEKYWRKEISEQELLDVAKDLREKNWKHQAAANADYVAVGDFTFYDHILDLQVATGAIPARFGFDSQNLPLEQFFQLARGNKDQFAIEMTKWFDTNYHYLVPEFHADTEFKANAKHYVQQLQEAQTLGLKAKPTVVGPLTFLWVGKEKGSVEFDRLSLLPKLLPVYVEILTALVEAGAEWIQIDEPALAVDLPKEWVEAYKDVYATLNKVSAKILLGTYFGSVAEHAALLKSLPVDGLHIDLVRAPEQLDAFAGYDKVLSAGVIDGRNIWRANLNKVLETVGPLQAKLGERLWISSSCSLLHTPFDLSVEEKLKANKPDLYSWLAFTLQKTQELRVLKAALNEGRDSVAEELAASQAAADSRANSSEIHRADVAKRLADLPVNAGQRKSPFADRIKAQQAWLNLPLLPTTNIGSFPQTTEIRQARAAFKKGELSASDYEAAMKKEIALVVEEQEKLDLDVLVHGEAERNDMVEYFGELLSGFAFTQYGWVQSYGSRCVKPPIIFGDVSRPEAMTVAWSTYAQNLTKRPMKGMLTGPVTILQWSFVRNDIPRATVCKQIALALNDEVLDLEKAGIKVIQIDEPAIREGLPLKRADWDAYLNWAGESFRLSSAGCEDSTQIHTHMCYSEFNDILPAIAAMDADVITIETSRSDMELLAAFGEFKYPNDIGPGVYDIHSPRVPTEAEVEHLLRKAIEVVPVERLWVNPDCGLKTRGWKETLEQLQVMMNVTRKLRAELAK

SEQ ID NO: 5563 - DNA, 876 bp, Neisseria gonorrhoeae
atgaattatgcaaaagaaatcaatgcgttaaacaacagcctttccgatttgaaaggcaacatcaacgtttcgtttgaatttttcccgccgaaaaacgaacaaatggaaacgatgctgtgggattccatccaccgtctgcaaaccctgcatcccaagttcgtatccgtaacttacggcgcaaactccggcgaacgcgaccgcacgcacggcatcgtcaaacgcatcaaacaggaaaccggtttggaagcagcttcgcacctgaccggcatcgatgcatcccacgacgaattgcgccaaatcgccaaagactattgggacagcggtatccgccgcatcgttgccctgcgtggcgacgagccggccggttatgagaaaaaaccgttttacgccgaagacttggttaagctattacgctccgtcgccgacttcgacatctctgtagcagcataccccgaagtacatcccgaagcgaaatccgcacaagccgacctgattaatctgaagcgcaaaatcgatgcgggcgcgaaccacgtcatcacccaattcttcttcgatgtggaacgctacctgcgcttccgcgaccgctgcgtgatgttgggcatcgacgtcgaaatcgttcccggcatcctgcctgttaccaacttcaagcaactcggcaaaatggctcaagtaaccaacgtcaaaatcccgaaatggctgtcgcaaatgtatgaaggcttggacgacgaccaaggcacgcgcaacctcgtcgccgccagtatcgccatcgatatggttaaagtcctgtcccgcgaaggcgtgaaagatttccacttctacacgctcaaccgcagcgagctgacttacgccatctgccatattttaggcgcgcgccct

SEQ ID NO: 5564 - protein, 292 aa, Neisseria gonorrhoeae
MNYAKEINALNNSLSDLKGNINVSFEFFPPKNEQMETMLWDSIHRLQTLHPKFVSVTYGANSGERDRTHGIVKRIKQETGLEAASHLTGIDASHDELRQIAKDYWDSGIRRIVALRGDEPAGYEKKPFYAEDLVKLLRSVADFDISVAAYPEVHPEAKSAQADLINLKRKIDAGANHVITQFFFDVERYLRFRDRCVMLGIDVEIVPGILPVTNFKQLGKMAQVTNVKIPKWLSQMYEGLDDDQGTRNLVAASIAIDMVKVLSREGVKDFHFYTLNRSELTYAICHILGARP

SEQ ID NO: 5565 - DNA, 273 bp, Neisseria gonorrhoeae
atgaaaccgaatattcatcctgacaattatcgaaccgtcctttttttcgacagcagtgccaatgaaggctggctgattcgttcttgcgccggaacgcacggaaaaacaatggtttggacagacggcaaagaatatctgctcttttccttagatacttcctcttcctcacatcccgtctataccggcaaacagcgtaacgtcaataccgaaggccgtgccagcaagttcaaccaacgtttccaatccgtcatgtcatcgtttagaaaggacaaa

SEQ ID NO: 5566 - protein, 91 aa, Neisseria gonorrhoeae
MKPNIHPDNYRTVLFFDSSANEGWLIRSCAGTHGKTMVWTDGKEYLLFSLDTSSSSHPVYTGKQRNVNTEGRASKFNQRFQSVMSSFRKDK

SEQ ID NO: 5567 - DNA, 975 bp, Neisseria gonorrhoeae; identical to SEQ ID NO: 13

SEQ ID NO: 5568 - protein, 325 aa, Neisseria gonorrhoeae; identical to SEQ ID NO: 14

SEQ ID NO: 5569 - DNA, 408 bp, Neisseria gonorrhoeae; identical to SEQ ID NO: 1333

SEQ ID NO: 5570 - protein, 136 aa, Neisseria gonorrhoeae; identical to SEQ ID NO: 1334

SEQ ID NO: 5571 - DNA, 198 bp, Neisseria gonorrhoeae
aaaatgactgaaactcaaaaaaaccggattcccgcgaaaacaggaatccggagtctcagggttggaaaaaccgtttttcccgataagtttccgtaccgacagacctagattcccgcctgcgcgggaatgacgatatttcagttttctgtttttgattttttttgtttttgcgggaatgacgatatagcggattaacaa

SEQ ID NO: 5572 - protein, 35 aa, Neisseria gonorrhoeae
KMTETQKNRIPAKTGIRSLRVGKTVFPDKFPYRQT

SEQ ID NO: 5573 - DNA, 123 bp, Neisseria gonorrhoeae
atgcaggttctgtcttcgctcaaaaccgccaaacaacgccaccgcgactgccaaatcgtcagacgcaggggcaaagtgtacgtcatctgcaaaagcaatccgcgttttaaatcgcgccaacgc

SEQ ID NO: 5574 - protein, 41 aa, Neisseria gonorrhoeae
MQVLSSLKTAKQRHRDCQIVRRRGKVYVICKSNPRFKSRQR

SEQ ID NO: 5575 - DNA, 195 bp, Neisseria gonorrhoeae
ttgaaaagggcttgcggtaggaggggctttacaaccgaaccaggaagggcagggggtcagcgttggcgcgatttaaaacgcggattgcttttgcagatgacgtacactttgcccctgcgtctgacgatttggcagtcgcggtggcgttgtttggcggttttgagcgaagacagaacctgcattatttgtcctttc

SEQ ID NO: 5576 - protein, 65 aa, Neisseria gonorrhoeae
LKRACGRRGFTTEPGRAGGQRWRDLKRGLLLQMTYTLPLRLTIWQSRWRCLAVLSEDRTCIICPF

SEQ ID NO: 5577 - DNA, 216 bp, Neisseria gonorrhoeae
atgataggcagacttttccgtatttttttctttttcgcacttgccgcgctgattatcaaccgcctctttagccgcaggcagaaacgtgtcctgcgcgaagtcgccgaaatcagcgcatgggtactgctcggtgcagccgccgcgacgctgttttggtatctgtttatgctgtatttcaaacacattccggattcgtatcgacggaaaaatgccgtc

SEQ ID NO: 5578 - protein, 72 aa, Neisseria gonorrhoeae
MIGRLFRIFFFFALAALIINRLFSRRQKRVLREVAEISAWVLLGAAAATLFWYLFMLYFKHIPDSYRRKNAV

SEQ ID NO: 5579 - DNA, 375 bp, Neisseria gonorrhoeae
gtgtttgaaatacagcataaacagataccaaaacagcgtcgcggcggctgcaccgagcagtacccatgcgctgatttcggcgacttcgcgcaggacacgtttctgcctgcggctaaagaggcggttgataatcagcgcggcaagtgcgaaaaagaaaaaaatacggaaaagtctgcctatcatgtcgggaagcgaaaagtatggttcgggcgcggcggcatgggaaaggatgtttcagcgcgtcaggctgcttgtccgaccgtgtcaaaaagtcatgccgtttgcgatataataacgcttttcgccgcatttgttggaacaggatatgagtcaaaatacctcggtgggcattgtaacgccccaaaaaattccgtt

SEQ ID NO: 5580 - protein, 125 aa, Neisseria gonorrhoeae
VFEIQHKQIPKQRRGGCTEQYPCADFGDFAQDTFLPAAKEAVDNQRGKCEKEKNTEKSAYHVGKRKVWFGRGGMGKDVSARQAACPTVSKSHAVCDIITLFAAFVGTGYESKYLGGHCNAPKNSV

SEQ ID NO: 5581 - DNA, 1119 bp, Neisseria gonorrhoeae
gtgggcattgtaacgccccaaaaaattccgtttgaaatgccgctggttttggaaaacggtaaaactttgccgcgtttcgatctgatgattgaaacctacggcgagctgaatgctgaaaaaaacaatgcggttttaatctgccacgcgctgtcgggcaaccatcacgttgcgggcaggcattcggcggaggataaatatacgggctggtgggacaatatggtcggtcccggaaaaccgattgatacggaacgttttttcgtggtcgggttgaacaatctgggcggctgcgacggcagcagcgggcctttgtcgatcaatcctgaaacgggcagggaatacggcgcggattttccgatggttacggtgaaggactgggtaaaatcacaagccgcgcttgccgattatctcggcatcgaacaatgggcggcggttgtcggcggcagcttgggcggcatgcaggctttgcagtgggcgatttcctatcccgaacgtgtgcgccacgccttggtgattgcgtctgcgccgaaactgtccgcgcaaaatatcgcgtttaatgatgtagcacgtcaggcgattttgaccgaccccgatttcaatgaaggacattaccgcagccacaacaccgttcccgcgcgcggtttgcggattgcccgtatgatgggacacattacgtatcttgccgaagacggtttgggcaaaaaattcggacgcgatttgcgttccaacggctatcaatacggctatagcgttgaatttgaagtagaatcctatctccgctatcaaggcgacaaattcgtcgggcggtttgatgctaatacatatttgctgatgaccaaagctttggactatttcgatccggcggcggatttcggcaacagcctgacccgcgccgtgcaggatgtgcaggcaaaattctttgtcgccagcttcagcaccgactggcgtttcgcgcccgaacgttcgcacgaactggtcaaggcactgattgccgcccaaaaatccgtgcagtatatcgaagtcaagtccgcacacgggcacgatgcctttttaatggaagacgaagcctatatgcgcgccgtaacggcttatatgaacaatgttgacaaggattgccgatta

SEQ ID NO: 5582 - protein, 373 aa, Neisseria gonorrhoeae
VGIVTPQKIPFEMPLVLENGKTLPRFDLMIETYGELNAEKNNAVLICHALSGNHHVAGRHSAEDKYTGWWDNMVGPGKPIDTERFFVVGLNNLGGCDGSSGPLSINPETGREYGADFPMVTVKDWVKSQAALADYLGIEQWAAVVGGSLGGMQALQWAISYPERVRHALVIASAPKLSAQNIAFNDVARQAILTDPDFNEGHYRSHNTVPARGLRIARMMGHITYLAEDGLGKKFGRDLRSNGYQYGYSVEFEVESYLRYQGDKFVGRFDANTYLLMTKALDYFDPAADFGNSLTRAVQDVQAKFFVASFSTDWRFAPERSHELVKALIAAQKSVQYIEVKSAHGHDAFLMEDEAYMRAVTAYMNNVDKDCRL

SEQ ID NO: 5583 - DNA, 480 bp, Neisseria gonorrhoeae
ttggcggaacacaaaaaatgcagcggctacggcatcgaaatcgacaccgacaacgtgattgctgcgatgtcgcgcggcgtaaatgttatccaagccgatttggaagaagggttgaccgcattcaacgatcaaagttttgatgtgattgttttgagccaaaccatccaagcgatgcagaataccgaaaaaatcctgcgctgcctgatgcgcctcgccaaacaggcaatcgtcagtttcccgaatttcggctactggcgcaaccgcgtccaaatcgcactcggcggacatatgccggtttccgaacgtatgccctaccattggtacgacacgcccaatatccattggtgcacgctcaaagactttgatttgttgtgcgccaaaaacaatatccgcgtcctcgaacgcgccgtgatgacgggcaacagacaggtcaaacatttccccaaccttttgggcagccttgcgttttaccgcgtcggg

SEQ ID NO: 5584 - protein, 160 aa, Neisseria gonorrhoeae
LAEHKKCSGYGIEIDTDNVIAAMSRGVNVIQADLEEGLTAFNDQSFDVIVLSQTIQAMQNTEKILRCLMRLAKQAIVSFPNFGYWRNRVQIALGGHMPVSERMPYHWYDTPNIHWCTLKDFDLLCAKNNIRVLERAVMTGNRQVKHFPNLLGSLAFYRVG

SEQ ID NO: 5585 - DNA, 201 bp, Neisseria gonorrhoeae
atgaaaaacaaaacgtcatcacttcccttatggcttgccgcaatcatgctggccgcgcgttccccgagcaaagaagataaaacgaaagaaaacggcgcatccgccgcttcgtcttccgcgtcatcggcttcttcccaaaccgatttgcaaccggccgcatccgcccctgataacgtcaagcaggcagaaagcgcgccactg

SEQ ID NO: 5586 - protein, 67 aa, Neisseria gonorrhoeae
MKNKTSSLPLWLAAIMLAARSPSKEDKTKENGASAASSSASSASSQTDLQPAASAPDNVKQAESAPL

SEQ ID NO: 5587 - DNA, 771 bp, Neisseria gonorrhoeae
tttccccgacaccctcgccgccagttcgtccgccaaggcaagatacgccttggcaccctttgcctgcgcgtcgtaagccatcaccggcataccgtggctcggcgcttccgcaaggcggatattgcgcgggatggcggtttcaaaaagcaaatccccgaaatggctgcgcaactgttcgctgacttcggcaaccagcctgctgcggctgtcgtacatcgtacgcacgatgcccgtgatgtccaaatcgggattgaccgcctgacggattttgcgcacggtcgcaatcaaatcggaaatcccttccagcgcgtaatattcgcacaacatcggcacaatcacgccgcccgccgccaccaagccgttaagcgtcaacagcgtcagcgaaggcggacagtcgatcaggataaagtcgtaatcttccgccactgccttgagcgcgtttttcaaacgcacttcccgggcgatttcctgcaccagctcgatttccgcgccggcaagcgcgcggttcgcacccaacacgccgtatccgccctctttgctgcgtaccgccgccgactgcacgtccgcatcgcccaataagacctgataaacgccggactgcaaacccgccttgtcgatgccgctgcccgtcgtcgcattgccctgcggatccaaatcgaccaccagcacgcgtttgccgcgcgatgccagcgaagccgccaaatttaccgtcgtcgtcgttttgcccacaccgcccttctgattggcgatggcaaggatgttcgcactcat

SEQ ID NO: 5588 - protein, 192 aa, Neisseria gonorrhoeae
FPRHPRRQFVRQGKIRLGTLCLRVVSHHRHTVARRFRKADIARDGGFKKQIPEMAAQLFADFGNQPAAAVVHRTHDARDVQIGIDRLTDFAHGRNQIGNPFQRVIFAQHRHNHAARRHQAVKRQQRQRRRTVDQDKVVIFRHCLERVFQTHFPGDFLHQLDFRAGKRAVRTQHAVSALFAAYRRRLHVRIAQ

SEQ ID NO: 5589 - DNA, 144 bp, Neisseria gonorrhoeae
ttgtatccgacagccccgtttagccgaaatgtcggattcaagaatccgacccacgccgctgacaatgccttaataggccgtctgaaaaatgataaatcaggtattcacaaccaccctacccttttcagacggcctctttccctt

SEQ ID NO: 5590 - protein, 48 aa, Neisseria gonorrhoeae
LYPTAPFSRNVGFKNPTHAADNALIGRLKNDKSGIHNHPTLFRRPLSL

SEQ ID NO: 5591 - DNA, 93 bp, Neisseria gonorrhoeae; identical to SEQ ID NO: 2131

SEQ ID NO: 5592 - protein, 31 aa, Neisseria gonorrhoeae; identical to SEQ ID NO: 2132

SEQ ID NO: 5593 - DNA, 438 bp, Neisseria gonorrhoeae
ttgccgcaatcatgctggccgcgcgttccccgagcaaagaagataaaacgaaagaaaacggcgcatccgccgcttcgtcttccgcgtcatcggcttcttcccaaaccgatttgcaaccggccgcatccgcccctgataacgtcaagcaggcagaaagcgcgccactgtgaaattgcaccggcctgcaccccgccgccggcattggcgatctcatacagcaaatcgccgaacacatcgactcggactgtctgtttgccctttcccataacgaactggaaacccgtttcggcttacccggcggcggctatgacaacatacagcggctgctgtttcccgacatccgccctgaagatcccgactaccatcagaaaatcatgctggcaatcgaagacttgcgttacggaacgcgcaccatcagccggcaggcacaagatgcca

SEQ ID NO: 5594 - protein, 146 aa, Neisseria gonorrhoeae
LPQSCWPRVPRAKKIKRKKTAHPPLRLPRHRLLPKPICNRPHPPLITSSRQKARHCEIAPACTPPPALAISYSKSPNTSTRTVCLPFPITNWKPVSAYPAAAMTTYSGCCFPTSALKIPTTIRKSCWQSKTCVTERAPSAGRHKMP

SEQ ID NO: 5595 - DNA, 465 bp, Neisseria gonorrhoeae
atggaacaggaacgccgcctccgagaagcgacgctgatgctgacacagggcagtcaaaaaacccgcggacaaggcgaggaaccgaaacgcgcacgttattttgaagtttcggcaacatctgcctatttgaaccggcacaacaacggacttggcggcaatttccaatacatcggccaattgcccggctatctgaaaatgcacggagaaatgcttgaaaaccaatcactcttccggctgtccaaccgtgaacgcaatcccgacaaaccgtttttagacatccattttgacgaaaatggcaaaatcacgcgtattgtcgtttacgaaaaaaatatctatagtggattaaatttaaatcaggacaaggcgacgaagccgaagacagtacagatagtacggcaaggcgaggcaacgctgtactggtttaaatttaatccactatacttcaatccaaacacggggcgaata

SEQ ID NO: 5596 - protein, 155 aa, Neisseria gonorrhoeae
MEQERRLREATLMLTQGSQKTRGQGEEPKRARYFEVSATSAYLNRHNNGLGGNFQYIGQLPGYLKMHGEMLENQSLFRLSNRERNPDKPFLDIHFDENGKITRIVVYEKNIYSGLNLNQDKATKPKTVQIVRQGEATLYWFKFNPLYFNPNTGRI

SEQ ID NO: 5597 - DNA, 558 bp, Neisseria gonorrhoeae
atgaaaacagcacaagaactgcgcgccggcaatgtatttatggtcggcaacgatcctatggtcgttcaaaaaaccgaatacatcaaaggcggccgctcttccgccaaagtcagcatgaaactgaaaaacctgctgaccggcgctgcttccgaaaccatttacaaagccgacgacaaattcgacgtggtcatcctgtcccgcaaaaactgtacgtacagctattttgccgacccgatgtacgtctttatggacgaagaattcaaccaatacgaaatcgaagccgacaacatcggcgacgcgttgaaattcatcgttgacggtatggaagaccaatgcgaagttaccttctatgaaggcaatcccatttctgtcgaactgcccaccatcatcgtgcgcgaagtcgagtacaccgagcctgccgtcaaaggcgatacttccggcaaagtgatgaaaaccgcgcgtctggtcggcggcaccgaaatccaagtgatgtcttacatcgaaaacggcgacaaagtcgaaatcgatacccgtaccggcgaattccgcaaacgcgcc

SEQ ID NO: 5598 - protein, 186 aa, Neisseria gonorrhoeae
MKTAQELRAGNVFMVGNDPMVVQKTEYIKGGRSSAKVSMKLKNLLTGAASETIYKADDKFDVVILSRKNCTYSYFADPMYVFMDEEFNQYEIEADNIGDALKFIVDGMEDQCEVTFYEGNPISVELPTIIVREVEYTEPAVKGDTSGKVMKTARLVGGTEIQVMSYIENGDKVEIDTRTGEFRKRA

SEQ ID NO: 5599 - DNA, 549 bp, Neisseria gonorrhoeae
ttggatttcggtgccgccgaccagacgcgcggttttcatcactttgccggaagtatcgcctttgacggcaggctcggtgtactcgacttcgcgcacgatgatggtgggcagttcgacagaaatgggattgccttcatagaaggtaacttcgcattggtcttccataccgtcaacgatgaatttcaacgcgtcgccgatgttgtcggcttcgatttcgtattggttgaattcttcgtccataaagacgtacatcgggtcggcaaaatagctgtacgtacagtttttgcgggacaggatgaccacgtcgaatttgtcgtcggctttgtaaatggtttcggaagcagcgccggtcagcaggtttttcagtttcatgctgactttggcggaagagcggccgcctttgatgtattcggttttttgaacgaccataggatcgttgccgaccataaatacattgccggcgcgcagttcttgtgctgttttcattgtgattttccaatcaaatcggttgtcgtaaaacgcgctattctagcgtattttttgatgctt

SEQ ID NO: 5600 - protein, 183 aa, Neisseria gonorrhoeae
LDFGAADQTRGFHHFAGSIAFDGRLGVLDFAHDDGGQFDRNGIAFIEGNFALVFHTVNDEFQRVADVVGFDFVLVEFFVHKDVHRVGKIAVRTVFAGQDDHVEFVVGFVNGFGSSAGQQVFQFHADFGGRAAAFDVFGFLNDHRIVADHKYIAGAQFLCCFHCDFPIKSVVVKRAILAYFLML

SEQ ID NO: 5601 - DNA, 1149 bp, Neisseria gonorrhoeae
atgaatacatacgcttttcctgtctgttggattttttgcaaggtcatcgacaatttcggcgacatcggcgtttcgtggcggctcgcccgtgttttgcaccgcgaactcggttggcaggtgcatttgtggacggacgacgtgtccgccttgcgcgcgctttgtcccgatttgcccgatgttcccttcgttcatcaggatattcatgtccgcacttggcattccgatgcggcagacattgataccgcgcccgttcccgatgccgttatcgaaacttttgcctgcgacctgcccgaaaatgtgctgaacatcatccgccgacacaaaccgctttggctgaattgggaatatttgagcgcggaggaaagcaatgaaaggctgcacctgatgccttcgccgcaggagggcgttcaaaaatatttttggtttatgggtttcagcgaaaaaagcggcgggttgatacgcgaacgcgattaccgcgaagccgtccgtttcgataccgaagccctgcgccggcggctggtgctgcccgaaaaaaacgcccccgaatggctgcttttcggctatcggggcgatgtttgggcaaagtggctggacatgtggcaacaggcaggcagcctgatgaccctactgctggcgggggcgcaaattatcgacagcctcaaacaaagcggcgttattccgcaaaacgccctgcaaaatgacggcggtgtctttcagacggcatccgtccgccttgtcaaaatcccgttcgtgccgcaacaggacttcgacaaattgctgcacctcgccgactgcgccgtgatacgcggcgaagacagtttcgtgcgtacccagcttgccggaaaaccctttttttggcacatctacccgcaagacgagaatgtccatctcgacaaactccacgccttttgggataaggcatacggcttctacacgcccgaaaccgcatcggtgcaccgcctcctttcggacgacctcaacggcggagaggctttatccgcaacacaacgcctcgaatgttggcaaaccctgcaacaacatcaaaacggctggcggcaaggcgcggaggattggagccgttatcttttcgggcagccttccgcatccgaaaaactcgccgcctttgtttcaaagcatcaaaaaatacgc

SEQ ID NO: 5602 - protein, 383 aa, Neisseria gonorrhoeae
MNTYAFPVCWIFCKVIDNFGDIGVSWRLARVLHRELGWQVHLWTDDVSALRALCPDLPDVPFVHQDIHVRTWHSDAADIDTAPVPDAVIETFACDLPENVLNIIRRHKPLWLNWEYLSAEESNERLHLMPSPQEGVQKYFWFMGFSEKSGGLIRERDYREAVRFDTEALRRRLVLPEKNAPEWLLFGYRGDVWAKWLDMWQQAGSLMTLLLAGAQIIDSLKQSGVIPQNALQNDGGVFQTASVRLVKIPFVPQQDFDKLLHLADCAVIRGEDSFVRTQLAGKPFFWHIYPQDENVHLDKLHAFWDKAYGFYTPETASVHRLLSDDLNGGEALSATQRLECWQTLQQHQNGWRQGAEDWSRYLFGQPSASEKLAAFVSKHQKIR

SEQ ID NO: 5603 - DNA, 306 bp, Neisseria gonorrhoeae
atggcgttttgcttttttgaaagccttgcaatgtcccgaaacctgcttgtccgctggctcgccgtctgcctcatccccttggcgacgcttgccgttttcgccgccaatccgcccgaagacaaaccccagcatctgatcaacggcatcatccttgcctgcgaagcgacgtttttgtttaaattcgtcctctttgaaaccatcaagcatcatcttaaacaagggtttgatttgaaacgtcaaaccatgtttctgtttattccgattgttttgctggttgtgtatttgttccactatttcggcgcgttt

SEQ ID NO: 5604 - protein, 102 aa, Neisseria gonorrhoeae
MAFCFFESLAMSRNLLVRWLAVCLIPLATLAVFAANPPEDKPQHLINGIILACEATFLFKFVLFETIKHHLKQGFDLKRQTMFLFIPIVLLVVYLFHYFGAF

SEQ ID NO: 5605 - DNA, 381 bp, Neisseria gonorrhoeae
gtggaacaaatacacaaccagcaaaacaatcggaataaacagaaacatggtttgacgtttcaaatcaaacccttgtttaagatgatgcttgatggtttcaaagaggacgaatttaaacaaaaacgtcgcttcgcaggcaaggatgatgccgttgatcagatgctggggtttgtcttcgggcggattggcggcgaaaacggcaagcgtcgccaaggggatgaggcagacggcgagccagcggacaagcaggtttcgggacattgcaaggctttcaaaaaagcaaaacgccattatcgcctcaagaacgcaccttgtctaacggacgcgccggagatgccgtctgaagccttgccgccggaaaacgccgcaccaccgaacctt

SEQ ID NO: 5606 - protein, 127 aa, Neisseria gonorrhoeae
VEQIHNQQNNRNKQKHGLTFQIKPLFKMMLDGFKEDEFKQKRRFAGKDDAVDQMLGFVFGRIGGENGKRRQGDEADGEPADKQVSGHCKAFKKAKRHYRLKNAPCLTDAPEMPSEALPPENAAPPNL

SEQ ID NO: 5607 - DNA, 135 bp, Neisseria gonorrhoeae
atgaatgaagataaatatagggaaaatatgacatgggatgaaattgaaaatgtagtaggaactttagtttctgaagaaagaatgcttaaatccaatagctttttaagtattaaaaatagtaagaataggttggct

SEQ ID NO: 5608 - protein, 45 aa, Neisseria gonorrhoeae
MNEDKYRENMTWDEIENVVGTLVSEERMLKSNSFLSIKNSKNRLA

SEQ ID NO: 5609 - DNA, 147 bp, Neisseria gonorrhoeae; identical to SEQ ID NO: 1369

SEQ ID NO: 5610 - protein, 49 aa, Neisseria gonorrhoeae; identical to SEQ ID NO: 1370

SEQ ID NO: 5611 - DNA, 621 bp, Neisseria gonorrhoeae
acgcttgctcaggatgacgatatggcgttccgcatccaagcccggcacgtcgagcctttggactttttcgacgcacacatcctgcggcaggcggccgatttccccctgcggatatacgcccttcatcgccgcccagtagccgccgtctttcaacaggtgcgccgtccacgacacaaaatccgccagttccgcaaacgcacggctggtaaccacgtcggcacgcacgtccgaaaccgcctccacgcgccccgacaccacgcgcacattgtccaaccccaactcgatagccgcctgccgcaaaaaagccgttttcttcgtattcgcatccaacaaggttatctgcacatccggacggcacaccgccgccggaatgccgggctggccgccgcccgaaccgacatccagcatcgtctgtgcgccttcgatatagggcagcagcgtcaggctgtccaaaagatgatggacaatcattttttcctcgtcgcgcagggcggtcagattgtaggttttgttccactttttcaacaaatccacataggccaaaagcctgtcctgcgccgtttccgaaatatccggccccatcgcggcaatgcctgcacgcaggcgttctttacgttccat

SEQ ID NO: 5612 - protein, 207 aa, Neisseria gonorrhoeae
TLAQDDDMAFRIQARHVEPLDFFDAHILRQAADFPLRIYALHRRPVAAVFQQVRRPRHKIRQFRKRTAGNHVGTHVRNRLHAPRHHAHIVQPQLDSRLPQKSRFLRIRIQQGYLHIRTAHRRRNAGLAAARTDIQHRLCAFDIGQQRQAVQKMMDNHFFLVAQGGQIVGFVPLFQQIHIGQKPVLRRFRNIRPHRGNACTQAFFTFH

SEQ ID NO: 5613 - DNA, 165 bp, Neisseria gonorrhoeae
atgcgtcgggctttcaatatgcccgcgcccgatgccgccttgtccgcaggcatcggcggcagcgtccgatttctcggggaacgcccgtcccgggtatatttaaaggttcggtggtgcggcgttttccggcggcaaggcttcagacggcatctccggcgcgtccgt

SEQ ID NO: 5614 - protein, 55 aa, Neisseria gonorrhoeae
MRRAFNMPAPDAALSAGIGGSVRFLGERPSRVYLKVRWCGVFRRQGFRRHLRRVR

SEQ ID NO: 5615 - DNA, 309 bp, Neisseria gonorrhoeae
atgtttcaggtttggaaaaatgcggattatagcggaaagcgcgccgcccttatattttgctttgcggaagcacgccgacggcaaggggcgggtttgccgtacgcctttataaaatgcgttcaaaccgatgcgtcgggctttcaatatgcccgcgcccgatgccgccttgtccgcaggcatcggcggcagcgtccgatttctcggggaacgcccgtcccgggtatatttaaaggttcggtggtgcggcgttttccggcggcaaggcttcagacggcatctccggcgcgtccgttagacaaggtgcgttct

SEQ ID NO: 5616 - protein, 103 aa, Neisseria gonorrhoeae
MFQVWKNADYSGKRAALIFCFAEARRRQGAGLPYAFIKCVQTDASGFQYARARCRLVRRHRRQRPISRGTPVPGIFKGSVVRRFPAARLQTASPARPLDKVRS

SEQ ID NO: 5617 - DNA, 213 bp, Neisseria gonorrhoeae
gtgcgggacaaaggcgcgttcggaggcggacggtttcgccgtgccgatgtccataccggtatagagcagtgcagaatcgaggctgatgatttcgaccggaagggtttcggcaattttgagggcgagcgcggttttgccgcaggcggtcggcccgagcagggtaaaggctttcggggtcggcataatgtttcaggtttggaaaaatgcggatta

SEQ ID NO: 5618 - protein, 71 aa, Neisseria gonorrhoeae
VRDKGAFGGGRFRRADVHTGIEQCRIEADDFDRKGFGNFEGERGFAAGGRPEQGKGFRGRHNVSGLEKCGL

SEQ ID NO: 5619 - DNA, 633 bp, Neisseria gonorrhoeae
atgatgtatttccgcgccctgacccaaggtttgaacgatttgcccgaagccgatgcctgcctgcgtgccgacttggacgaacaaaaacagatgtacggtttggattttctctaccgcaccctgcaaaaagtcgaccctgaaacagcatgccgtctgaaaccgaacgacagccagcgcatcggacgcgcccttgaagtctattacctgaccggcaggccgatgagcgcgcacctgaacggacagcccgaacacaccctgcccttcgaactctacaccgccgccctgattcccgaagaccgcgcccgactgcacgaaaacatcgccctgcgtttccacctgatgcttgaacagggctttatcggcgaagtagaaaacctgcgccgccgctatcccggcctgaccgccgactcccccgccatccgctgcgtcggctaccgtcaggcgtgggaacacctcgacggtgcaaccgacagacaaaccttcatcgaaaaaggcattgccgccacgcgccaacttgccaaacgccaactgacttggttacgcaaaacacctttagactgcgttgccgacccgttttcagacggcacttcaggcacgcgcctgattgaggcggcaaaacggtttttcggcgaa

SEQ ID NO: 5620 - protein, 211 aa, Neisseria gonorrhoeae
MMYFRALTQGLNDLPEADACLRADLDEQKQMYGLDFLYRTLQKVDPETACRLKPNDSQRIGRALEVYYLTGRPMSAHLNGQPEHTLPFELYTAALIPEDRARLHENIALRFHLMLEQGFIGEVENLRRRYPGLTADSPAIRCVGYRQAWEHLDGATDRQTFIEKGIAATRQLAKRQLTWLRKTPLDCVADPFSDGTSGTRLIEAAKRFFGE

SEQ ID NO: 5621 - DNA, 717 bp, Neisseria gonorrhoeae
atgctggccacgccgccgctcgcccccaaaaccgtcgccgccctgcacaggctcggtatccgtacgctcgaagaactgcggcaaaacggttcggtcaaagcctttctgctgctcaaagcatcgggtttgaccctcacgaaaagcacgctgtggcaactcgagtcgctgctgaacggcacgccgccgcaagaaatgtcccaagcgcataaagactgcctgcttgccgagttgaaaaaccatccgcccgtcgccgcctttccgccgcaggaagaaatgggatacttcatgcgcgaagcactgcgccaagcagaacaatccgccgccgacggcgaaatacccgtcggggcagtcatcgtttcagacggcaaaatcatcacatcggcacacaacacctgcattgccgactgcaatgtcagccgacacgccgaaatcaacgccttggcacaggcaggcagcgaaatgcaaaactaccgccttgacggatgcgacatctacatcaccctcgaaccctgcgccatgtgcgcgtccgcactgatacaggcacgaatcaggcgcgtgatctacggtgcggcagaacccaaaaccggcgcggcaggcagcatcgtcaacctgtttgccgacaaacgcctcaatacgcacaccgccatacggggcggaatcctgcaagaagaatgccgcgccgtattaagccgttttttccaaaacaaaagaaaaggt

SEQ ID NO: 5622 - protein, 239 aa, Neisseria gonorrhoeae
MLATPPLAPKTVAALHRLGIRTLEELRQNGSVKAFLLLKASGLTLTKSTLWQLESLLNGTPPQEMSQAHKDCLLAELKNHPPVAAFPPQEEMGYFMREALRQAEQSAADGEIPVGAVIVSDGKIITSAHNTCIADCNVSRHAEINALAQAGSEMQNYRLDGCDIYITLEPCAMCASALIQARIRRVIYGAAEPKTGAAGSIVNLFADKRLNTHTAIRGGILQEECRAVLSRFFQNKRKG

SEQ ID NO: 5623 - DNA, 486 bp, Neisseria gonorrhoeae
atgaccgccctactcgtcatcctcgccctcgccctgatagccgtcggcacggcaggcatcgtctatcccgccctgcccggcttggcattgatgtttgccggaacatggctgcttgcctatgccggcggctatcaaatctacggcgcaggcatcttgtggacggtcggactcatcagccttggcggcatactggcggactatatggcaggcatgttgggggtaaaatacactggggcaggcaaactcgccgtccgaggtgcattggccggcagcatcatcggcatatttttctcccttcccggactaatactcggcccctttatcggcgcggcggcaggcgaactgatcgatcggcgcaatatgcttcaggcaggtaaagcgggcttgggtacgctgttggggcttgtcgtcggcacggcgttcaaaatcggctgcgccgtatccatcttgtttatcctgttggtgaaatacatcgcatacctgttt

SEQ ID NO: 5624 - protein, 162 aa, Neisseria gonorrhoeae
MTALLVILALALIAVGTAGIVYPALPGLALMFAGTWLLAYAGGYQIYGAGILWTVGLISLGGILADYMAGMLGVKYTGAGKLAVRGALAGSIIGIFFSLPGLILGPFIGAAAGELIDRRNMLQAGKAGLGTLLGLVVGTAFKIGCAVSILFILLVKYIAYLF

SEQ ID NO: 5625 - DNA, 876 bp, Neisseria gonorrhoeae
gtgtcccgtctgatgttgaaaaaaagaaaaacagtgcggaattttacctttatccgcacaaaaaaggtattcatgccgtctgaagcgcgctcaacgcttgctcaggatgacgatatggcgttccgcatccaagcccggcacgtcgagcctttggactttttcgacgcacacatcctgcggcaggcggccgatttccccctgcggatatacgcccttcatcgccgcccagtagccgccgtctttcaacaggtgcgccgtccacgacacaaaatccgccagttccgcaaacgcacggctggtaaccacgtcggcacgcacgtccgaaaccgcctccacgcgccccgacaccacgcgcacattgtccaaccccaactcgatagccgcctgccgcaaaaaagccgttttcttcgtattcgcatccaacaaggttatctgcacatccggacggcacaccgccgccggaatgccgggctggccgccgcccgaaccgacatccagcatcgtctgtgcgccttcgatatagggcagcagcgtcaggctgtccaaaagatgatggacaatcattttttcctcgtcgcgcagggcggtcagattgtaggttttgttccactttttcaacaaatccacataggccaaaagcctgtcctgcgccgtttccgaaatatccggccccatcgcggcaatgcctgcacgcaggcgttctttacgttccatatctgcttcctgtccatattcaggcgtaatgttagcggaaaaacatgccgtctgaaaccgcgtatcgggtttcagacggcatttccgttccgtcctattttttcctgtggaacaccacaggctgcaccggcgcgcgcgtcaggcgtttcggcagcgtcagca

SEQ ID NO: 5626 - protein, 292 aa, Neisseria gonorrhoeae
VSRLMLKKRKTVRNFTFIRTKKVFMPSEARSTLAQDDDMAFRIQARHVEPLDFFDAHILRQAADFPLRIYALHRRPVAAVFQQVRRPRHKIRQFRKRTAGNHVGTHVRNRLHAPRHHAHIVQPQLDSRLPQKSRFLRIRIQQGYLHIRTAHRRRNAGLAAARTDIQHRLCAFDIGQQRQAVQKMMDNHFFLVAQGGQIVGFVPLFQQIHIGQKPVLRRFRNIRPHRGNACTQAFFTFHICFLSIFRRNVSGKTCRLKPRIGFQTAFPFRPIFSCGTPQAAPARASGVSAASA

SEQ ID NO: 5627 - DNA, 180 bp, Neisseria gonorrhoeae; identical to SEQ ID NO: 2481

SEQ ID NO: 5628 - protein, 60 aa, Neisseria gonorrhoeae; identical to SEQ ID NO: 2482

SEQ ID NO: 5629 - DNA, 765 bp, Neisseria gonorrhoeae
ttgacaaacaccattatggcaaaccaaagacccatctacggcttccacgccgtcaacgcccgattgtggcaaaaccccaaatcgattaccgaactctatatccaagaaggcaaatccgacgcacgcacgcgcgaagtgctggaaaaggcggcaaacgaaaacatccgcgtatattttgccgatgccgaccgcctcaacgccatcagcaaaggcgcgcgccatcagggcgtggtcggatttatcgatgcctccaaaaaccacgtccacctcgaagacgtattggaaaacttgagcgaaccgccgctgctgctgatactcgacggcatcaccgatccgcacaacctcggcgcgtgcctgcgtaccgccgacgcaatgggcgtacacgccgtcatcgcgccgaaagacaaaagcgcgggactgaacgccaccgtcagcaaagtcgcctgcggcgcggcggaaaccgtcccctacatcaccgtaaccaacctcgcccgcaccctgcgcgaattgaaagaatacggcatttggatcatcggcaccgacatgggcggcgacgccgacctttaccattgcaatctgcccgacagcacggcgtgggtgatgggcaacgaaggcgacggtatgcgccgcctcacgcgcgaacattgcgacatgctggtgtccatacccatgttcggcacggtcgaaagcatgaacgtctccgtgtccgcaggaatggtattaagcgaaacccgccggcaacgcgtattgaaaaacaaaaaagcg

SEQ ID NO: 5630 - protein, 255 aa, Neisseria gonorrhoeae
LTNTIMANQRPIYGFHAVNARLWQNPKSITELYIQEGKSDARTREVLEKAANENIRVYFADADRLNAISKGARHQGVVGFIDASKNHVHLEDVLENLSEPPLLLILDGITDPHNLGACLRTADAMGVHAVIAPKDKSAGLNATVSKVACGAAETVPYITVTNLARTLRELKEYGIWIIGTDMGGDADLYHCNLPDSTAWVMGNEGDGMRRLTREHCDMLVSIPMFGTVESMNVSVSAGMVLSETRRQRVLKNKKA

SEQ ID NO: 5631 - DNA, 723 bp, Neisseria gonorrhoeae
gtggcaaaaccccaaatcgattaccgaactctatatccaagaaggcaaatccgacgcacgcacgcgcgaagtgctggaaaaggcggcaaacgaaaacatccgcgtatattttgccgatgccgaccgcctcaacgccatcagcaaaggcgcgcgccatcagggcgtggtcggatttatcgatgcctccaaaaaccacgtccacctcgaagacgtattggaaaacttgagcgaaccgccgctgctgctgatactcgacggcatcaccgatccgcacaacctcggcgcgtgcctgcgtaccgccgacgcaatgggcgtacacgccgtcatcgcgccgaaagacaaaagcgcgggactgaacgccaccgtcagcaaagtcgcctgcggcgcggcggaaaccgtcccctacatcaccgtaaccaacctcgcccgcaccctgcgcgaattgaaagaatacggcatttggatcatcggcaccgacatgggcggcgacgccgacctttaccattgcaatctgcccgacagcacggcgtgggtgatgggcaacgaaggcgacggtatgcgccgcctcacgcgcgaacattgcgacatgctggtgtccatacccatgttcggcacggtcgaaagcatgaacgtctccgtgtccgcaggaatggtattaagcgaaacccgccggcaacgcgtattgaaaaacaaaaaagcgtaagcctcaaaaacaatgccgtc

SEQ ID NO: 5632 - protein, 241 aa, Neisseria gonorrhoeae
VAKPQIDYRTLYPRRQIRRTHARSAGKGGKRKHPRIFCRCRPPQRHQQRRAPSGRGRIYRCLQKPRPPRRRIGKLERTAAAADTRRHHRSAQPRRVPAYRRRNGRTRRHRAERQKRGTERHRQQSRLRRGGNRPLHHRNQPRPHPARIERIRHLDHRHRHGRRRRPLPLQSARQHGVGDGQRRRRYAPPHARTLRHAGVHTHVRHGRKHERLRVRRNGIKRNPPATRIEKQKSVSLKNNAV

SEQ ID NO: 5633 - DNA, 1062 bp, Neisseria gonorrhoeae
atgaaagagggcggtttgagtgagggggcgatggtttcgacgctcttgggcgtatcgtttgccggtgcgtttttggtgtgtttctcggcgtggctgctgccgtatttgaaaaaagtgattacgccgacggttagcggcgtggtcgtgatgctcattggtttgagtttggtacacgtcggtattgccgatttcggcggcggcttcggcgcgaaggcggacggcacgttcggctcgatggaaaacttggggctggcttcgctggtactgctgattgtgttgatatttaactgcatgaaaaatccgctgctgcggatgagcggcattgcggtcggtctgattgccggctacattgtcgcgctgtttttgggcaaggtggatttttccgcactgcaaaacctgccgccggttacgctgcccgtaccgtttaaatatggttttgcttttgactggcacgcatttattgcggcgggtgcgattttcttgttgggcgtgtttgaggcggtcggcgatttgacggcaacggcaatggtgtccgaccagccgattgaaggcgaagaatacaccaaacgcctgcgcggcggcgtgttggctgacggcttggtatcggtgattgcgacggctttgggttcgctgccgctgacgacgtttgcgcaaaacaacggcgtgattcagatgaccggagtggcttcgcgccacgtgggcaaatatattgccgtgattttggtgctgttgggtctgttccccgttgtcggacgcgcgtttacgacgattccgagtccggtgttgggcggcgcgatggttttgatgttcggcctgattgcgattgcgggcgtgcggattttggtcggccacggcatccgcaggcgcgaggcggtgattgcggcaacgtcggtcggtttgggcttgggcgtggggtttgagccggaagtgtttaaaaacctgcccgtcttgttccaaaactctatttccggcggcggcattacggcagtcttgctgaatttggtcttgccggaagataaaaccgaggcggcggtcaagtttgataccgaccatttggaacac

SEQ ID NO: 5634 - protein, 354 aa, Neisseria gonorrhoeae
MKEGGLSEGAMVSTLLGVSFAGAFLVCFSAWLLPYLKKVITPTVSGVVVMLIGLSLVHVGIADFGGGFGAKADGTFGSMENLGLASLVLLIVLIFNCMKNPLLRMSGIAVGLIAGYIVALFLGKVDFSALQNLPPVTLPVPFKYGFAFDWHAFIAAGAIFLLGVFEAVGDLTATAMVSDQPIEGEEYTKRLRGGVLADGLVSVIATALGSLPLTTFAQNNGVIQMTGVASRHVGKYIAVILVLLGLFPVVGRAFTTIPSPVLGGAMVLMFGLIAIAGVRILVGHGIRRREAVIAATSVGLGLGVGFEPEVFKNLPVLFQNSISGGGITAVLLNLVLPEDKTEAAVKFDTDHLEH

SEQ ID NO: 5635 - DNA, 330 bp, Neisseria gonorrhoeae
atggctgaaacaatgaaaaaacaggcggattcgcctgatttggtgtacggtttggaagacaggccgccgttcggtaatgcgctcttgagcgcggttacccatcttttggcgattttcgtgccgatgattacgcccgcgctgattgtgggcggcgcgctggaattgccggtggagatgacggcgtatctggtgtcgatggcgatggttgcgtcgggtgtcggcacttatttgcaggtcaaccgcttcgggtcggtcggctcggggatgctgtccatccagcgttaccgtcatgattgcgctcggcgcggggatgaaagagggcggtttgag

SEQ ID NO: 5636 - protein, 110 aa, Neisseria gonorrhoeae
MAETMKKQADSPDLVYGLEDRPPFGNALLSAVTHLLAIFVPMITPALIVGGALELPVEMTAYLVSMAMVASGVGTYLQVNRFGSVGSGMLSIQRYRHDCARRGDERGRFE

SEQ ID NO: 5637 - DNA, 420 bp, Neisseria gonorrhoeae
atgacggtaacgctggatggacagcatccccgagccgaccgacccgaagcggttgacctgcaaataagtgccgacacccgacgcaaccatcgccatcgacaccagatacgccgtcatctccaccggcaattccagcgcgccgcccacaatcagcgcgggcgtaatcatcggcacgaaaatcgccaaaagatgggtaaccgcgctcaagagcgcattaccgaacggcggcctgtcttccaaaccgtacaccaaatcaggcgaatccgcctgttttttcattgtttcagccattggagtctttctatccgttgccaaacgttaaaaaattttaagaacgaaattgtaacgaatcaaagattccttatcaattcaaatcctcatgtgcaaaaacaccaccggttgtccgaattcaaatttctt

SEQ ID NO: 5638 - protein, 140 aa, Neisseria gonorrhoeae
MTVTLDGQHPRADRPEAVDLQISADTRRNHRHRHQIRRHLHRQFQRAAHNQRGRNHRHENRQKMGNRAQERITERRPVFQTVHQIRRIRLFFHCFSHWSLSIRCQTLKNFKNEIVTNQRFLINSNPHVQKHHRLSEFKFL

SEQ ID NO: 5639 - DNA, 873 bp, Neisseria gonorrhoeae
atgttacaaggtagcttggttgccctgattaccccgatgaatcaagacggcagcatccattacgaccaactccgccaattaatcgactggcacatcgaaaacggcacggacggcatcgtcgctgccggcacgacaggcgaatccgccaccctctccgtcgaagaacatttaagcgtaatcgaagaaacggtcaaacacgttgccaaacgcgtccccgtcatcgccggcacaggggcgaacaacaccgtcgaagccatcgccctttcccaagccgccgaaaaagccggcgcggactacaccctctccgtcgtcccctattacaacaaaccttcccaagaaggcatgtaccgccatttcaaagccgttgccgaagccgccgcgattccgatgatactctacaacgtgcccggcagaaccgtcgtcagcatgaacaacgaaaccatcctgcgccttgccgaaatccccaacatcgtcggcgttaaagaagcaagcggcaacgtcggcagcaacatcgaactcatcaaccgcgcgcccgaaggcttcgccgtcctttccggcgacgaccacaccgccctgccgttcatgctctgcggcggacacggcgttattaccgtagccgccaacgccgccccgaaactctttgccgatatgtgccgtgccgcgctgcaaggcgacattgcccttgcacgcgaactcaacgaccggctgattccgatttacgacaccatgttctgcgaacccagtcccgccgcaccgaaatgggcggtatccgccttgggcagatgcggaccgcacgtccgcctgccgctcgttccgctgacggaaggcggacaggcaaaagtccgcgccgccctgaaagcctcaggacaactt

SEQ ID NO: 5640 - protein, 291 aa, Neisseria gonorrhoeae
MLQGSLVALITPMNQDGSIHYDQLRQLIDWHIENGTDGIVAAGTTGESATLSVEEHLSVIEETVKHVAKRVPVIAGTGANNTVEAIALSQAAEKAGADYTLSVVPYYNKPSQEGMYRHFKAVAEAAAIPMILYNVPGRTVVSMNNETILRLAEIPNIVGVKEASGNVGSNIELINRAPEGFAVLSGDDHTALPFMLCGGHGVITVAANAAPKLFADMCRAALQGDIALARELNDRLIPIYDTMFCEPSPAAPKWAVSALGRCGPHVRLPLVPLTEGGQAKVRAALKASGQL

SEQ ID NO: 5641 - DNA, 1194 bp, Neisseria gonorrhoeae
atgccgtctgaaccgttcggacggcataacatgacaaacactttaatatccatcacacaggatgacacgatgacccatatcaaacccgtcattgccgcgctcgcactcatcgggcttgccgcctgctccggcagcaaaaccgaacagcccaagctcgactaccaaagccggtcgcaccgcctgatcaaactcgaagtcccgcctgatttgaacaaccccgaccaaggcaacctctaccgcctgcctgccggttcgggagccgtccgcgccagcgatttggaaaaacgccgcacacccgccgtccaacagccagccgatgccgaagtattgaaaagcgtcaaaggcgtccgcctcgagcgcgacggcagccaacgctggcttgtcgttgacggcaaatcccccgccgaaatctggccgcttctgaaagccttttggcaggaaaacggcttcgacatcgaatccgaagaacccgccatcggacaaatggaaaccgagtgggcggaaaaccgtgccaaaatcccccaagacagcttgcgccgcctattcgacacagtcggtttgggcggcatctactccaccggcgagcgcgacaaattcatcgtccgtatcgaacagggcaaaaacggcgtttccgacatcttcttcgcccacaaagcgatgaaagaagtgtatggcgacaaaaacaaagacacgaccatgtggcagccttccgcttccgaccccaaccttgaggccgctttcctgacgcgctttatgcaatatttgggcgttgacggacggcaggcggaaaacgcattggcaaaaaaaccgacccttcccgccgccaacgaaatggcgcgtatcgaaggcaaaagcctgattgtctttggcgactacggcagaaactggcggcgcaccggccttgccctcgaccgcatcggactgaccgtcgtcggtcaaaacaccgaacgccacgccttcctggttcaaaaagccccgaacgaaagcaatgcagttaccgaacaaaaaccggggctgttcaaacgcctactgggcaaaggcaaagcggagaaacctgccgaacagccggaactgattgtctatgccgagcctgtcgccgacggttcgcgcatcgtcctgctcaacaaagacggcagcgcatatgccggcaaagacgcatccgcactgttaggcaaactccattccgaactgcgt

SEQ ID NO: 5642 - protein, 398 aa, Neisseria gonorrhoeae
MPSEPFGRHNMTNTLISITQDDTMTHIKPVIAALALIGLAACSGSKTEQPKLDYQSRSHRLIKLEVPPDLNNPDQGNLYRLPAGSGAVRASDLEKRRTPAVQQPADAEVLKSVKGVRLERDGSQRWLVVDGKSPAEIWPLLKAFWQENGFDIESEEPAIGQMETEWAENRAKIPQDSLRRLFDTVGLGGIYSTGERDKFIVRIEQGKNGVSDIFFAHKAMKEVYGDKNKDTTMWQPSASDPNLEAAFLTRFMQYLGVDGRQAENALAKKPTLPAANEMARIEGKSLIVFGDYGRNWRRTGLALDRIGLTVVGQNTERHAFLVQKAPNESNAVTEQKPGLFKRLLGKGKAEKPAEQPELIVYAEPVADGSRIVLLNKDGSAYAGKDASALLGKLHSELR

SEQ ID NO: 5643 - DNA, 933 bp, Neisseria gonorrhoeae
atgatgtatgaaataaaacagccttttcatagcggatacttgcaggtgtctgaaattcatcaaatttattgggaagagtcgggcaatcccgacggtgtgccggtcatttttttacacggcgggccgggcgcgggggcttcgcctgaatgtcggggttttttcaatcctgatgtgttccgcatcgtcatcatcgaccagcgcggttgcggacgttcgcacccgtatgcttgtgcggaagacaatacgacttgggatttggtggcggatattgaaaaagtccgtgaaatgctgggtatcgggaaatggctggtgttcggcggttcgtggggcagcactttgtcgctggcttatgcccaaacccatcccgaacgggtaaagggattggtgttgcgcgggatatttttgtgcaggccgtctgaaacggcgtggctgaacgaggcgggcggcgtgagccggatttatccggaacaatggcaaaaatttgtcgcgccgattgctgaaaatcggcggaaccggctgattgaggcgtatcacgggttgctgtttcatcaagatgaagaagtgtgcctgtctgccgcgaaggcttgggcggattgggaaagctatctgattcgtttcgagccggagggagtggatgaagatgcttatgcctcactggcaatcgcgcgtttggaaaaccattattttgtcaacggcggttggttgcagggtgataaggcgattttgaacaatatcggcaaaatacggcatatcccgaccgttatcgtgcaggggcggtatgatttgtgtacgcctatgcagagtgcgtgggagctgtcgaaagcctttcccgaagcggaattgagggtggtccaggcggggcattgtgcgttcgatccgcctttggcggatgcgttggttcaggcggttgaggatattttgccccgtttgttg

SEQ ID NO: 5644 - protein, 311 aa, Neisseria gonorrhoeae
MMYEIKQPFHSGYLQVSEIHQIYWEESGNPDGVPVIFLHGGPGAGASPECRGFFNPDVFRIVIIDQRGCGRSHPYACAEDNTTWDLVADIEKVREMLGIGKWLVFGGSWGSTLSLAYAQTHPERVKGLVLRGIFLCRPSETAWLNEAGGVSRIYPEQWQKFVAPIAENRRNRLIEAYHGLLFHQDEEVCLSAAKAWADWESYLIRFEPEGVDEDAYASLAIARLENHYFVNGGWLQGDKAILNNIGKIRHIPTVIVQGRYDLCTPMQSAWELSKAFPEAELRVVQAGHCAFDPPLADALVQAVEDILPRLL

SEQ ID NO: 5645 - DNA, 294 bp, Neisseria gonorrhoeae
gtgttggatttgagggcaggggcttgcgccattttgaatcaagccctgccccgccgccttgaagggcggggtttaactgttaggaaacaatggcaaagcggcttgtttctgtcagacattgtatgggttttcttttcaatgatatattttcgcctgtttatgcaatattttccgattgatggtttttatcgcgatttttcggcatttgcctttcggggcggcttgtgtttcgtgcgggatgtcgcgtgtcgggatgttcggattgtcagaagcaatatgggagaagatgatgta

SEQ ID NO: 5646 - protein, 98 aa, Neisseria gonorrhoeae
VLDLRAGACAILNQALPRRLEGRGLTVRKQWQSGLFLSDIVWVFFSMIYFRLFMQYFPIDGFYRDFSAFAFRGGLCFVRDVACRDVRIVRSNMGEDDV

SEQ ID NO: 5647 - DNA, 606 bp, Neisseria gonorrhoeae; identical to SEQ ID NO: 15

SEQ ID NO: 5648 - protein, 202 aa, Neisseria gonorrhoeae; identical to SEQ ID NO: 16

SEQ ID NO: 5649 - DNA, 123 bp, Neisseria gonorrhoeae; identical to SEQ ID NO: 2651

SEQ ID NO: 5650 - protein, 41 aa, Neisseria gonorrhoeae; identical to SEQ ID NO: 2652

SEQ ID NO: 5651 - DNA, 696 bp, Neisseria gonorrhoeae
gtgcaggcggatttagcctacgccgccgaacgcattacccacgattatccggaaccaaccggtgcaaaaaaagacaaaaaaataagcacggtaagcgattatttcagaaacatccgtacgcattccgtccaccccagggtgtcggtcggctacgatttcggcagctggaggatagcggcagattatgcccgttacagaaagtggaacaacagtaaatattccgtcaacataaaaagggtgaaagaaaacaatggcagcgggaaaaaactgacgcaagacctgaagacggaaaatcaggaaaacggtacgttccacgccgtttcttctctcggcttgtccgccgtttacgatttcgataccggttcccgcttcaaaccctatgcaggcgtgcgcgtcagctacggacacgtcagacacagcatcgattcgaccaaaaaaacaacagatgttattaccgccccccccactacttctgacggagcacctacaacttataatgctaatccacagacgcaaaacccttatcaccaaagcgacagcatccgccgcgtgggcctcggcgtcatcgccggcgtcggtttcgacatcacgcccaacctgaccctggacaccggctaccgctaccacaactggggacgcctggaaaacacccgcttcaaaacccacgaagcctcattgggcatgcgctaccgcttc

SEQ ID NO: 5652 - protein, 232 aa, Neisseria gonorrhoeae
VQADLAYAAERITHDYPEPTGAKKDKKISTVSDYFRNIRTHSVHPRVSVGYDFGSWRIAADYARYRKWNNSKYSVNIKRVKENNGSGKKLTQDLKTENQENGTFHAVSSLGLSAVYDFDTGSRFKPYAGVRVSYGHVRHSIDSTKKTTDVITAPPTTSDGAPTTYNANPQTQNPYHQSDSIRRVGLGVIAGVGFDITPNLTLDTGYRYHNWGRLENTRFKTHEASLGMRYRF

SEQ ID NO: 5653 - DNA, 171 bp, Neisseria gonorrhoeae
atgacgggttttaagattgcggtgttgtcggacgggtttcgagattacggtattgtcgggaatgacggttcgggtattttactgcgcccgccccgcgcctgtaaacggcaggtgcatcaaaaatgccgtctgaaggttcagacggcatcggtatcggggaatcagaagcgg

SEQ ID NO: 5654 - protein, 57 aa, Neisseria gonorrhoeae
MTGFKIAVLSDGFRDYGIVGNDGSGILLRPPRACKRQVHQKCRLKVQTASVSGNQKR

SEQ ID NO: 5655 - DNA, 2787 bp, Neisseria gonorrhoeae
ttgtttattgttgaggaaaatatgagatcttctttccggttgaagccgatttgtttttatcttatgggtgttatgctatatcatcatagttatgccgaagatgcagggcgcgcgggcagcgaggcgcagatacaggttttggaagatgtgcacgtcaaggcgaagcgcgtaccgaaagacaaaaaagtgtttaccgatgcgcgtgccgtatcgacccgtcaggatgtgttcaaatccggcgaaaacctcgacaacatcgtacgcagcatacccggtgcgtttacacagcaagataaaagctcgggcattgtgtctttgaatattcgcggcgacagcgggttcgggcgggtcaatacgatggtggacggcatcacgcagaccttttattcgacttctaccgatgcgggcagggcaggcggttcatctcaattcggtgcatctgtcgacagcaattttattgccggactggatgtcgtcaaaggcagcttcagcggctcggcaggcatcaacagccttgccggttcggcgaatctgcggactttaggcgtggatgacgtcgttcagggcaataatacctacggcctgctgctaaaaggtctgaccggcaccaattcaaccaaaggtaatgcgatggcggcgataggtgcgcgcaaatggctggaaagcggagcgtctgtcggtgtgctttacgggcacagcaggcgcggcgtggcgcaaaattaccgcgtgggcggcggcgggcagcacatcggaaattttggtgaagaatatctggaacggcgcaaacagcaatattttgtacaagagggtggtttgaaattcaatgccggcagcggaaaatgggaacgggatttgcaaaggcaatactggaaaacaaagtggtataaaaaatacgaagacccccaagaactgcaaaaatacatcgaagagcatgataaaagctggcgggaaaacctggcgccgcaatacgacatcacccccatcgatccgtccggcctgaagcagcagtcggcaggcaatctgtttaaattggaatacgacggcgtattcaataaatacacggcgcaatttcgcgatttaaacaccagaatcggcagccgcaaaatcatcaaccgcaattatcaattcaattacggtttgtctttgaacccgtataccaacctcaatctgaccgcagcctacaattcgggcaggcagaaatatccgaaaggggcgaagtttacaggctgggggcttttaaaagattttgaaacctacaacaacgcgaaaatcctcgacctcaacaacaccgccaccttccggctgccccgcgaaaccgagttgcaaaccactttgggcttcaattatttccacaacgaatacggcaaaaaccgctttcctgaagaattggggctgtttttcgacggtcctgatcaggacaacgggctttattcctatttggggcggtttaagggcgataaagggctgttgcctcaaaaatcaaccattgtccaaccggccggcagccaatatttcaacacgttctacttcgatgccgcgctcaaaaaagacatttaccgcttaaactacagcaccaatgcaatcaactaccgtttcggcggcgaatatacgggctattacggctcggaaaacgaatttaagcgggcattcggagaaaactcgccggcatacaaggaacattgcgacccgagctgcgggctttatgaacccgtattgaaaaaatacggcaaaaagcgcgccaacaaccattcggtcagcattagtgcggacttcggcgattatttcatgccgttcgccggctattcgcgcacacaccgtatgcccaacatccaagaaatgtatttttcccaaatcggcgactccggcgttcacaccgccttaaaaccagagcgcgcaaacacttggcaatttggcttcaatacctataaaaaaggattgttaaaacaagatgatatattaggattgaaactggtcggctaccgcagccgcattgacaactacatccacaacgtttacgggaaatggtgggatttgaacggggatattccgagctgggtcggcagcaccgggcttgcctacaccatccgacaccgcaatttcaaagacaaagtgcacaaacacggttttgagctggagctgaattacgattatgggcgttttttcaccaacctttcttacgcctatcaaaaaagcacgcaaccgaccaatttcagcgatgcgagcgaatcgcccaacaatgcctccaaagaagaccaactcaaacaaggttatgggctgagcagggtttccgccctgccgcgagattacggacgtttggaagtcggtacgcgctggttgggcaacaaactgactttgggcggcgcgatgcgctatttcggcaagagcatccgcgcgacggctgaagaacgctatatcgacggcaccaacgggggaaataccagcaatgtccggcaactgggcaagcgttccatcaaacaaaccgaaacccttgcccgacagcctttgatttttgatttttacgccgcttacgagccgaagaaaaaccttattttccgcgccgaagtcaaaaacctgttcgacaggcgttatatcgatccgctcgatgcgggcaatgatgcggcaacgcagcgttattacagctcgttcgacccgaaagacaaggacgaagacgtaacgtgtaatgctgataaaacgttgtgcaacggcaaatacggcggcacaagcaaaagcgtattgaccaatttcgcacgcggacgcaccttcttgatgacgatgagctacaagttt

SEQ ID NO: 5656 - protein, 929 aa, Neisseria gonorrhoeae
LFIVEENMRSSFRLKPICFYLMGVMLYHHSYAEDAGRAGSEAQIQVLEDVHVKAKRVPKDKKVFTDARAVSTRQDVFKSGENLDNIVRSIPGAFTQQDKSSGIVSLNIRGDSGFGRVNTMVDGITQTFYSTSTDAGRAGGSSQFGASVDSNFIAGLDVVKGSFSGSAGINSLAGSANLRTLGVDDVVQGNNTYGLLLKGLTGTNSTKGNAMAAIGARKWLESGASVGVLYGHSRRGVAQNYRVGGGGQHIGNFGEEYLERRKQQYFVQEGGLKFNAGSGKWERDLQRQYWKTKWYKKYEDPQELQKYIEEHDKSWRENLAPQYDITPIDPSGLKQQSAGNLFKLEYDGVFNKYTAQFRDLNTRIGSRKIINRNYQFNYGLSLNPYTNLNLTAAYNSGRQKYPKGAKFTGWGLLKDFETYNNAKILDLNNTATFRLPRETELQTTLGFNYFHNEYGKNRFPEELGLFFDGPDQDNGLYSYLGRFKGDKGLLPQKSTIVQPAGSQYFNTFYFDAALKKDIYRLNYSTNAINYRFGGEYTGYYGSENEFKRAFGENSPAYKEHCDPSCGLYEPVLKKYGKKRANNHSVSISADFGDYFMPFAGYSRTHRMPNIQEMYFSQIGDSGVHTALKPERANTWQFGFNTYKKGLLKQDDILGLKLVGYRSRIDNYIHNVYGKWWDLNGDIPSWVGSTGLAYTIRHRNFKDKVHKHGFELELNYDYGRFFTNLSYAYQKSTQPTNFSDASESPNNASKEDQLKQGYGLSRVSALPRDYGRLEVGTRWLGNKLTLGGAMRYFGKSIRATAEERYIDGTNGGNTSNVRQLGKRSIKQTETLARQPLIFDFYAAYEPKKNLIFRAEVKNLFDRRYIDPLDAGNDAATQRYYSSFDPKDKDEDVTCNADKTLCNGKYGGTSKSVLTNFARGRTFLMTMSYKF

SEQ ID NO: 5657 - DNA, 213 bp, Neisseria gonorrhoeae
atgccgtctgaaagcccttcagacggcatttgtttccccaaacgcatcatcctgccgcaagcctatgccaatccgttttatcgcatcggcaactcaaagaaaaatccatttcattcccacgcagggaagccggtttttgatttcggttatttttggttgtttcgggtaatttatgagtcgtcattcccgcaaaagcgggaatcagttttttta

SEQ ID NO: 5658 - protein, 71 aa, Neisseria gonorrhoeae
MPSESPSDGICFPKRIILPQAYANPFYRIGNSKKNPFHSHAGKPVFDFGYFWLFRVIYESSFPQKRESVFL

SEQ ID NO: 5659 - DNA, 168 bp, Neisseria gonorrhoeae
atgcccgccctttgtgcttaccgttttaacgcatttccgaaattaataaataatctgaaaaaagcgggtaagccaaagatggtaatcatcgttgccatcatgcgcaaactggcgaagcccgcctattacattgttaaaaccgggcagccttacgatgcggaaagacac

SEQ ID NO: 5660 - protein, 56 aa, Neisseria gonorrhoeae
MPALCAYRFNAFPKLINNLKKAGKPKMVIIVAIMRKLAKPAYYIVKTGQPYDAERH

SEQ ID NO: 5661 - DNA, 147 bp, Neisseria gonorrhoeae
atgtttcacggtttaaaacggacaacggcactgcctttatcgggcagtgccgttttgtctgccgcccgaacgttcggacggcatattttgactttggaacaaaaaataaaataccctaaaaaattaactatatatgacaaattgaaa

SEQ ID NO: 5662 - protein, 49 aa, Neisseria gonorrhoeae
MFHGLKRTTALPLSGSAVLSAARTFGRHILTLEQKIKYPKKLTIYDKLK

SEQ ID NO: 5663 - DNA, 1152 bp, Neisseria gonorrhoeae
gtggccaaacgtgtcgctaaagcccgcgccgaaggacacgatatcgtcgtcgtcgtatccgccatgagcggcgaaaccaaccgtctggttgcgttggcgcacgaaatgcaggagcatcccgatccgcgcgagctggacgtcgtcttagctaccggcgaacaagtaaccatcggccttttggcaatggcattgaaggatatcggcgtggatgccaaaagctacacaggctggcaggtctccctcaaaaccgataccgcccacaccaaagcccgcatagaaagcattgatgacgaaaaaatgcgcgccgacctcgccgccggcaaagtcgtcatcgttgccggcttccaaggcatcagcagtgaaggcaatatttccacgctaggacgcggcggttccgacacttccgccgttgcgcttgccgcagccctcaaagcggacgaatgccaaatctataccgacgtagacggcgtttacaccaccgacccccgcgtcgtacccgaagcgcgccgtatggatacggttacatttgaagaaatgatcgaactggccagcctcggttcgaaagttttgcaaatccgttcagtagaattcgccggaaaatacaaagtgcgcctgcgcgtactgagcagcctgcaagacggcggcaacggcaccttaattacctttgaagaggacgacaacatggaaagagctgccgtaaccggtatcgcattcgataaaaaccaagcccgcatcaacgtgcgcggtgtgcccgataagcccggcgtcgcctatcagattttgggcgcggtcgcagatgccaacatcgaagtcgatatgattatccaaaatgtcggcagcgaaggcacaaccgatttttctttcaccgtaccgcgcggcgattacaaacagactttggaaatcctgtcggaacgtaaagacagtatcggcgcagcttctatcgacggcgacgacaccgtgtgcaaagtctccgcagtcggtttgggtatgcgttcgcacgtcggcgtagccgccaaaatcttccgcacgctcgccgaagagggcatcaacatccaaatgatttccacctccgaaatcaaagtttccgtattgattgacgaaaaatacatggaactggcaaccagggtattgcataaagcctttgatttgggc

SEQ ID NO: 5664 - protein, 384 aa, Neisseria gonorrhoeae
VAKRVAKARAEGHDIVVVVSAMSGETNRLVALAHEMQEHPDPRELDVVLATGEQVTIGLLAMALKDIGVDAKSYTGWQVSLKTDTAHTKARIESIDDEKMRADLAAGKVVIVAGFQGISSEGNISTLGRGGSDTSAVALAAALKADECQIYTDVDGVYTTDPRVVPEARRMDTVTFEEMIELASLGSKVLQIRSVEFAGKYKVRLRVLSSLQDGGNGTLITFEEDDNMERAAVTGIAFDKNQARINVRGVPDKPGVAYQILGAVADANIEVDMIIQNVGSEGTTDFSFTVPRGDYKQTLEILSERKDSIGAASIDGDDTVCKVSAVGLGMRSHVGVAAKIFRTLAEEGINIQMISTSEIKVSVLIDEKYMELATRVLHKAFDLG

SEQ ID NO: 5665 - DNA, 105 bp, Neisseria gonorrhoeae
atggcttatgtggtgttggtcatggtatttgtgtcgctgtttgaatacctgattccaagcctttgtaaattttgtttatgccgtggaggagatgatgatctgtct

SEQ ID NO: 5666 - protein, 35 aa, Neisseria gonorrhoeae
MAYVVLVMVFVSLFEYLIPSLCKFCLCRGGDDDLS

SEQ ID NO: 5667 - DNA, 243 bp, Neisseria gonorrhoeae
gtgcgaggcccaaggcactcacacttatcggtaatctgttttgttaaagagcgttgcgaaattataaagtatcccttccgcctgtctaagatatctctcgatatttccgacattccgtgctatacttttcagttcgtccgccgcttcggcagcggcgaagaaccgaactatacgcccgcaggggaaaacagtcaatactttcagcgggatttttttggggaaattcgtcatgtcgctgtcgga

SEQ ID NO: 5668 - protein, 81 aa, Neisseria gonorrhoeae
VRGPRHSHLSVICFVKERCEIIKYPFRLSKISLDISDIPCYTFQFVRRFGSGEEPNYTPAGENSQYFQRDFFGEIRHVAVG

SEQ ID NO: 5669 - DNA, 552 bp, Neisseria gonorrhoeae
ttttttcctgtggaacaccacaggctgcaccggcgcgcgcgtcaggcgtttcggcagcgtcagcatagacaccagccacacggcaaacgcatattccgacaccgcctccccgctcagcccgcccaaggcggcactgcccaacaacagcttgaaaatccaagccaccgccgcgcaagccgccacgcccgacagaaacagcgcgtaacgcgaatgccgccgcatcatctttttgtacgccagtttcgtcaggcccgccgacacaaccacattcaaaaacgcaaacacaccgaacacaaaccaaacagtgccgtcccaaccgccacgccggccgaatccgccgtccgacaccgacaccagcagccccgcccgtccgaacgcacatgcaaaggcatcatgcaccgccaacgcaaacggcagcgtcaaaaacaccagccccgcaaacagggtcgcataaggatatttctcgttcacaaacatcgccgtcccccctcttccgaagcaggccgcattataccgcgcaccgccttgccgcccgcccgaaaagttgcacaa

SEQ ID NO: 5670 - protein, 184 aa, Neisseria gonorrhoeae
FFPVEHHRLHRRARQAFRQRQHRHQPHGKRIFRHRLPAQPAQGGTAQQQLENPSHRRASRHARQKQRVTRMPPHHLFVRQFRQARRHNHIQKRKHTEHKPNSAVPTATPAESAVRHRHQQPRPSERTCKGIMHRQRKRQRQKHQPRKQGRIRIFLVHKHRRPPSSEAGRIIPRTALPPARKVAQ

SEQ ID NO: 5671 - DNA, 210 bp, Neisseria gonorrhoeae
atgcgctcgggcgagcctacggatgtgccgccgtatttatgtacgattaacgccatgtttcatgctttcttgtgtgggattggtcgggcagcatggtttgctggaaaagcggctattattactattttttacatgaagttcaagaacggactgcgctttcccgcctgccgtttgacagcggtcagcgaaaaacctgttctttcagatttt

SEQ ID NO: 5672 - protein, 70 aa, Neisseria gonorrhoeae
MRSGEPTDVPPYLCTINAMFHAFLCGIGRAAWFAGKAAIITIFYMKFKNGLRFPACRLTAVSEKPVLSDF

SEQ ID NO: 5673 - DNA, 183 bp, Neisseria gonorrhoeae
gtgtgggattggtcgggcagcatggtttgctggaaaagcggctattattactattttttacatgaagttcaagaacggactgcgctttcccgcctgccgtttgacagcggtcagcgaaaaacctgttctttcagatttttgacaaaatgccgtctgaacggttttcagacggcatacggacag

SEQ ID NO: 5674 - protein, 61 aa, Neisseria gonorrhoeae
VWDWSGSMVCWKSGYYYYFLHEVQERTALSRLPFDSGQRKTCSFRFLTKCRLNGFQTAYGQ

SEQ ID NO: 5675 - DNA, 726 bp, Neisseria gonorrhoeae
atgcctgattatatccgcacctcacgcgccgccgacagcctgcgcgatatcaaaatcacccctcatttcctgccgcatacggacggttcgtgccttattgaatgcggtaataccaaagtgatttgtaccgcttccgtggacgaaaatgccccaccgtttctgcacggcaaaaaccaaggctgggtaacggcggaatacggtatgctgcctgcctcaaccgctttgcgtatgcgccgcgaagcttcggcgggcaaacagtcgggacgcacacaagaaatccaacgcttgatcgggcgttcgctgcgcgcggtcgtggatatggaaaaactcggcgaacgacaaatcctgattgattgcgatgtgattcaggcggacggcggcacgcgtacggcttcgattaccggtgcgtttgtcgcgctgcaaatcgccgtcggcaaactggtttcagacggcattttgagtgaaaaccccatccttgaagctgttgccgccgtatcagcgggcgtagtgaacggcgtgccgcttttggatttggattatcccgaagactccggctgcgacagtgatgtgaacatcgtcatgaccgcatcggggaaaatcatcgaaatacagggaacggcggaaggcgcgccattcagtttggacgagttgggcaaactggttgcactggcgcaaaaaggcataggcgaactgctgcgttatcagcaaaatgcgttgtccgttgct

SEQ ID NO: 5676 - protein, 242 aa, Neisseria gonorrhoeae
MPDYIRTSRAADSLRDIKITPHFLPHTDGSCLIECGNTKVICTASVDENAPPFLHGKNQGWVTAEYGMLPASTALRMRREASAGKQSGRTQEIQRLIGRSLRAVVDMEKLGERQILIDCDVIQADGGTRTASITGAFVALQIAVGKLVSDGILSENPILEAVAAVSAGVVNGVPLLDLDYPEDSGCDSDVNIVMTASGKIIEIQGTAEGAPFSLDELGKLVALAQKGIGELLRYQQNALSVA

SEQ ID NO: 5677 - DNA, 462 bp, Neisseria gonorrhoeae
atgtacaaacatctggtcgttgccgttgacggcagtgaaacgtccatcaatgccctgaaacacgccgccgagcttgccggggtcaacggtgcgcgtctgactttggtacacgttgccaatcctgccgaatatatggcgctcgcccccgaatttttgcaacacgaaagttacgaggccgccgccgtcgcgcaaggcaacgaggttttggatgccgccgagcgcaccgcccgggaactgggtgtgggaaataccgtcaaacacctgctggttgccaataagggtgcgcgcgaaatggcgcaggatttggtcgattatgccgatgaaaacggtgccggcctgctggtgttgggcacgcacgggcgcaccgggctgatgcaccttttgatgggcagtttcgccgaaacggtaatgcgccaaagccacctgccgcttttgattatccgtagcaaagccgaagaggcg

SEQ ID NO: 5678 - protein, 154 aa, Neisseria gonorrhoeae
MYKHLVVAVDGSETSINALKHAAELAGVNGARLTLVHVANPAEYMALAPEFLQHESYEAAAVAQGNEVLDAAERTARELGVGNTVKHLLVANKGAREMAQDLVDYADENGAGLLVLGTHGRTGLMHLLMGSFAETVMRQSHLPLLIIRSKAEEA

SEQ ID NO: 5679 - DNA, 555 bp, Neisseria gonorrhoeae
gtggctttggcgcattaccgtttcggcgaaactgcccatcaaaaggtgcatcagcccggtgcgcccgtgcgtgcccaacaccagcaggccggcaccgttttcatcggcataatcgaccaaatcctgcgccatttcgcgcgcacccttattggcaaccagcaggtgtttgacggtatttcccacacccagttcccgggcggtgcgctcggcggcatccaaaacctcgttgccttgcgcgacggcggcggcctcgtaactttcgtgttgcaaaaattcgggggcgagcgccatatattcggcaggattggcaacgtgtaccaaagtcagacgcgcaccgttgaccccggcaagctcggcggcgtgtttcagggcattgatggacgtttcactgccgtcaacggcaacgaccagatgtttgtacatatcgtattctccttttgcaccgtctcacggtgccgtctcttcaggtttgcgcaaaggcagtctgcgccgtttcattatagacccgccgtcgggctttatacaacagccgaacagcctgactgctttccagta

SEQ ID NO: 5680 - protein, 185 aa, Neisseria gonorrhoeae
VALAHYRFGETAHQKVHQPGAPVRAQHQQAGTVFIGIIDQILRHFARTLIGNQQVFDGISHTQFPGGALGGIQNLVALRDGGGLVTFVLQKFGGERHIFGRIGNVYQSQTRTVDPGKLGGVFQGIDGRFTAVNGNDQMFVHIVFSFCTVSRCRLFRFAQRQSAPFHYRPAVGLYTTAEQPDCFPV

SEQ ID NO: 5681 - DNA, 105 bp, Neisseria gonorrhoeae
atgccgccgaagcgtcgcgaagaggtcaaagcgttgtcggacatggtcgaatcctgcaagattgcgtcaaatcaaaaagtgaacgaaagccggcaaaaaaatgcc

SEQ ID NO: 5682 - protein, 35 aa, Neisseria gonorrhoeae
MPPKRREEVKALSDMVESCKIASNQKVNESRQKNA

SEQ ID NO: 5683 - DNA, 759 bp, Neisseria gonorrhoeae
ttgacctcttcgcgacgcttcggcggcatcgccagactctacggagactctgccttgacgcacttttcacaggcacacgtctgcgtggtcggcgtgggcggggtcggctcgtgggcggtcgaggctttggcgcgcacgggcatcgggcgtttgactttgattgatttggacaacgttgccgaatcgaatgccaaccgccagctgcacgccctgaccggcgacttcggcaaagcaaaagttaccgccttgcgcgaacgtattacacaaatcaatccgcaatgcgaagtatttgaaattgaagatttcgttaccgaagacaatttgccggaatacttcggaaaaggttttgatttcgtcatcgacgcgatcgaccaagtgcgcgtcaaagcggcaatggcggcttattttgtggaacgcaaacaaccgtttgtcctcagcggcggcgcgggcggacagaaaaatcccgccctgattcaaaccgccgatttaagccgcgtaacccacgacccgctgcttgccaacctgcgctacaccttgcggaaacgctacggcttcagccgcgatactaaggaaaaaatgcgcgtgccgtgcgtgtattcgaccgaaaatatcatgccgccgcaatcgggcgcagcgtgttctgccgatgccgcgccgcagggcttgtcatgcgccggctatggcgcaagtatgctcgttaccgcttcgttcggactgtattgcgcacaggcggcggtggaacacatcgcgggcaaaaaa

SEQ ID NO: 5684 - protein, 253 aa, Neisseria gonorrhoeae
LTSSRRFGGIARLYGDSALTHFSQAHVCVVGVGGVGSWAVEALARTGIGRLTLIDLDNVAESNANRQLHALTGDFGKAKVTALRERITQINPQCEVFEIEDFVTEDNLPEYFGKGFDFVIDAIDQVRVKAAMAAYFVERKQPFVLSGGAGGQKNPALIQTADLSRVTHDPLLANLRYTLRKRYGFSRDTKEKMRVPCVYSTENIMPPQSGAACSADAAPQGLSCAGYGASMLVTASFGLYCAQAAVEHIAGKK

SEQ ID NO: 5685 - DNA, 147 bp, Neisseria gonorrhoeae
ttgcaggttcaaactgaaatcgcgcacgatggggtcgcggaggatttcaaaacgcacgttttcaagacagatcatcatctcctccacggcataaacaaaatttacaaaggcttggaatcaggtattcaaacagcgacacaaatacca

SEQ ID NO: 5686 - protein, 49 aa, Neisseria gonorrhoeae
LQVQTEIAHDGVAEDFKTHVFKTDHHLLHGINKIYKGLESGIQTATQIP

SEQ ID NO: 5687 - DNA, 129 bp, Neisseria gonorrhoeae
atgccgtctgaaacaggattcagacggcatttgaacaaacgcggcaatcaagctgtcggttcagaaaaaccaacatcggcacgcctaaaaccgtattcacaatctactccttttcaaaatatttgcatt

SEQ ID NO: 5688 - protein, 43 aa, Neisseria gonorrhoeae
MPSETGFRRHLNKRGNQAVGSEKPTSARLKPYSQSTPFQNICI

SEQ ID NO: 5689 - DNA, 228 bp, Neisseria gonorrhoeae
ttgcatttaaaagccgttataatgccgtccgaacatctgcccgaccacattatgcgtgaatgccggcagattgttttcttttgtaaacttatattaaaattcacttaccaattcacgccatgccgcccatccctgccctatccgcaccatccgagcacactgtcgcatgggtattcggccaacccgttaccgatttgccgcaggatttgtttatcccgcccgacgcgc

SEQ ID NO: 5690 - protein, 76 aa, Neisseria gonorrhoeae
LHLKAVIMPSEHLPDHIMRECRQIVFFCKLILKFTYQFTPCRPSLPYPHHPSTLSHGYSANPLPICRRICLSRPTR

SEQ ID NO: 5691 - DNA, 765 bp, Neisseria gonorrhoeae
ttgtttatcccgcccgacgcgctgaaagtcgtattgggcagttttcaaggccctttggatctgctgctctaccttatccgcaagcagaacatcgatgttctcgatattccgatggtggaaattaccgggcagtatctgcactatattgcccaaatggaagcctatcagtttgatttggcggcggaatatcttttgatggcggcaatgctgattgaaatcaaatcgcgcctgctgctgccgcgtaccgaagccgtcgaagacgaagaggccgacccgcgtgccgagttggtgcgccgtctgcttgcctacgagcaaatgaaactggcggcgcagggtttggacgcgctgccgcgtgcgggacgggatttcgcgtgggcttacctgccgctggaaattgcagccgagacgaagctgcccgaggtttacatcgccgatttgatgcaggcatggttgggcattctttctcgggcaaaacatacgcgcagccacgaagtaatccaagaaaccctttccgtgcgcgcgcaaatgacggcaatcctgcgccgtttgaacgaacacgggatatgcaggtttcacgccctgttcaatcccgaacagggcgcggcttacgtgatcgtcaacttcatcgccctgttggagcttgccaaagaaggattggtcggaatcgtacaggaagacggtttcggagaaatccgaatcagcctcaatcatgagggggcgcattcagacggcattttcggcacacggggcgggcgcgatgtgttc

SEQ ID NO: 5692 - protein, 255 aa, Neisseria gonorrhoeae
LFIPPDALKVVLGSFQGPLDLLLYLIRKQNIDVLDIPMVEITGQYLHYIAQMEAYQFDLAAEYLLMAAMLIEIKSRLLLPRTEAVEDEEADPRAELVRRLLAYEQMKLAAQGLDALPRAGRDFAWAYLPLEIAAETKLPEVYIADLMQAWLGILSRAKHTRSHEVIQETLSVRAQMTAILRRLNEHGICRFHALFNPEQGAAYVIVNFIALLELAKEGLVGIVQEDGFGEIRISLNHEGAHSDGIFGTRGGRDVF

SEQ ID NO: 5693 - DNA, 1305 bp, Neisseria gonorrhoeae
atgagggggcgcattcagacggcattttcggcacacggggcgggcgcgatgtgttctaatacgccccaagccgccaccagaaatcgggagacacgccatatgaccggcatcatacattcgctgctcgacactgacctctacaaattcactatgctgcaagtagtcctgcaccagtttccgcagacgcacagcctttacgaattccgctgccgcaacgtctcgaccgtctatccgcttgccgacatcagggaagacttggaagccgaactcgacgcgctctgccggctgcgcttcacccacgacgaactcggctatctgcgctccctgcgtttcatcaaaagcgactttgtcgattatctcgaactcttccagctccaacgccgctttgtcgaagtcggcacagacgataaaggccgtctgaacatccgtatcgaaggcccgatgatacaggcgatgttttttgaaatcttcatcctcgccattgtcaacgaactttacttccgccggctggaaacccctgccgttatcgaagaaggcgaacgccggcttcaagccaaagccgcgcgcctgaaagaaatcgccgccgcacagaatccggacgaaccgcccttcctgatttccgacttcggcacgcgccgccgctacaagctcgcgtggcaggaacacgtcatccgcaccctgctcgaagccgccccaagcatcgtgcgcggcacaagcaacgtttacctcgccaaaaaactcggcatcacccccatcggcaccatggcgcacgaattcctccaagccttccaagccctcgacgtgcgcctgcggaatttccaaaaggccgcgctcgaaagctgggtgcacgaataccggggcgatttgggcgttgccctgaccgacgtggtcggtatggatgccttcctgcgcgatttcgacctctatttcgccaaactctttgacgggctgcgccacgacagcggcgacccttacgtttggggcgacaaagcctacgcccactatcaaaagctcaaaatcgacagccgcaccaaaatgctgaccttctccgacgggctggacatcgaacgctcttgggcattgcaccaatatttcaaaggccgcttcaaaaccggcttcggcatcggcaccaacctcaccaacgatatggggcatacgcccttgaatatcgtgttgaaactggtcgaatgcaacgggcagtccgtcgccaagctctccgactcgccgggcaaaaccatgaccaacaacagcaccttcctcgcctacctgcgccaagtgttcggcatacccgaacctagaacgccg

SEQ ID NO: 5694 - protein, 435 aa, Neisseria gonorrhoeae
MRGRIQTAFSAHGAGAMCSNTPQAATRNRETRHMTGIIHSLLDTDLYKFTMLQVVLHQFPQTHSLYEFRCRNVSTVYPLADIREDLEAELDALCRLRFTHDELGYLRSLRFIKSDFVDYLELFQLQRRFVEVGTDDKGRLNIRIEGPMIQAMFFEIFILAIVNELYFRRLETPAVIEEGERRLQAKAARLKEIAAAQNPDEPPFLISDFGTRRRYKLAWQEHVIRTLLEAAPSIVRGTSNVYLAKKLGITPIGTMAHEFLQAFQALDVRLRNFQKAALESWVHEYRGDLGVALTDVVGMDAFLRDFDLYFAKLFDGLRHDSGDPYVWGDKAYAHYQKLKIDSRTKMLTFSDGLDIERSWALHQYFKGRFKTGFGIGTNLTNDMGHTPLNIVLKLVECNGQSVAKLSDSPGKTMTNNSTFLAYLRQVFGIPEPRTP

SEQ ID NO: 5695 - DNA, 1404 bp, Neisseria gonorrhoeae
atgaagttcggtctttcggttaaattcaaatcaggcggtattttaaaagattttatgcggcggaaacaggaattgtacgctttttctgccggtttacggcgttctaggttcgggtatgccgaacacttggcgcaggtaggcgaggaaggtgctgttgttggtcatggttttgcccggcgagtcggagagcttggcgacggactgcccgttgcattcgaccagtttcaacacgatattcaagggcgtatgccccatatcgttggtgaggttggtgccgatgccgaagccggttttgaagcggcctttgaaatattggtgcaatgcccaagagcgttcgatgtccagcccgtcggagaaggtcagcattttggtgcggctgtcgattttgagcttttgatagtgggcgtaggctttgtcgccccaaacgtaagggtcgccgctgtcgtggcgcagcccgtcaaagagtttggcgaaatagaggtcgaaatcgcgcaggaaggcatccataccgaccacgtcggtcagggcaacgcccaaatcgccccggtattcgtgcacccagctttcgagcgcggccttttggaaattccgcaggcgcacgtcgagggcttggaaggcttggaggaattcgtgcgccatggtgccgatgggggtgatgccgagttttttggcgaggtaaacgttgcttgtgccgcgcacgatgcttggggcggcttcgagcagggtgcggatgacgtgttcctgccacgcgagcttgtagcggcggcgcgtgccgaagtcggaaatcaggaagggcggttcgtccggattctgtgcggcggcgatttctttcaggcgcgcggctttggcttgaagccggcgttcgccttcttcgataacggcaggggtttccagccggcggaagtaaagttcgttgacaatggcgaggatgaagatttcaaaaaacatcgcctgtatcatcgggccttcgatacggatgttcagacggcctttatcgtctgtgccgacttcgacaaagcggcgttggagctggaagagttcgagataatcgacaaagtcgcttttgatgaaacgcagggagcgcagatagccgagttcgtcgtgggtgaagcgcagccggcagagcgcgtcgagttcggcttccaagtcttccctgatgtcggcaagcggatagacggtcgagacgttgcggcagcggaattcgtaaaggctgtgcgtctgcggaaactggtgcaggactacttgcagcatagtgaatttgtagaggtcagtgtcgagcagcgaatgtatgatgccggtcatatggcgtgtctcccgatttctggtggcggcttggggcgtattagaacacatcgcgcccgccccgtgtgccgaaaatgccgtctgaatgcgccccctcatgat

SEQ ID NO: 5696 - protein, 468 aa, Neisseria gonorrhoeae
MKFGLSVKFKSGGILKDFMRRKQELYAFSAGLRRSRFGYAEHLAQVGEEGAVVGHGFARRVGELGDGLPVAFDQFQHDIQGRMPHIVGEVGADAEAGFEAAFEILVQCPRAFDVQPVGEGQHFGAAVDFELLIVGVGFVAPNVRVAAVVAQPVKEFGEIEVEIAQEGIHTDHVGQGNAQIAPVFVHPAFERGLLEIPQAHVEGLEGLEEFVRHGADGGDAEFFGEVNVACAAHDAWGGFEQGADDVFLPRELVAAARAEVGNQEGRFVRILCGGDFFQARGFGLKPAFAFFDNGRGFQPAEVKFVDNGEDEDFKKHRLYHRAFDTDVQTAFIVCADFDKAALELEEFEIIDKVAFDETQGAQIAEFVVGEAQPAERVEFGFQVFPDVGKRIDGRDVAAAEFVKAVRLRKLVQDYLQHSEFVEVSVEQRMYDAGHMACLPISGGGLGRIRTHRARPVCRKCRLNAPPHD

SEQ ID NO: 5697 - DNA, 1743 bp, Neisseria gonorrhoeae
ttgaatttaaccgaaagaccgaacttcatgaacctacatcaaaccgtcgaacacgaagccgccgccgcctttgccgccgcaggcatcgccggcagccccgttgtcttgcagccgaccaaaaatgccgagcacggcgatttccaaatcaacggcgtgatgggtgcggcgaaaaaagccaaacaaaatccgcgcgaactggcgcaaaaggtcgccgacgcattggcgggcaacgccgtcatcgaaagcgcggaagtggccggacccggctttatcaacctgcgcctgcgccacgaatttctcgctcaaaacattcatgcggctttgaacgatgcgcgtttcggcgtagcgaaaactgcccaaccgcaaaccgtcgtcatcgactattcctcgcccaatctggcgaaggaaatgcacgtcggccatctgcgttccagcatcatcggcgacagtatttcgcgcgtgttggaatttacgggcaacaccgttatccgtcaaaaccacgtcggcgactggggtacgcagttcggcatgttggtcgcttatttggtcgagcagcaaaaagacaatgccgcgttcgagctggcggatttggagcagttttaccgcgccgccaaagtgcgctttgacgaagaccctgcctttgccgacaccgcacgcgaatacgttgtgaagctgcaaggcggcgatgaaaccgtgttggcgttgtggaaacagtttgtcgatatttcgctctcgcacgcccaagccgtttacgacacgctgggcttgaagctgcgccccgaagacgtggcgggcgaatcgaaatacaacgacgatttgcagcccgtagccgatgatttggttcaaaaaggcctggcggttgaggacgacggcgcgaaagtcgtgttcttggacgagttcaaaaacaaagagggcgaacctgccgcatttatcgtgcaaaaacaaggcggcggcttcctttatgcttccaccgatttggcgtgcctgcgctaccgcataggccgtctgaaagccggccgcctgctgtacgtcgtcgaccaccgccaagccctgcacttcgaacaacttttcaccacttcccgcaaagcaggctatctgcctgaagatgcaaaagccgagtttatcggcttcggcaccatgatgggcaaagacggcaaaccgttcaaaacgcgcagcggcgacaccgtaaaactggttgacctgctgaccgaagccgtcgagcgcgccaccgctttggtgaaagaaaaaaatcccgaattgggcgcggatgaagccgccaaaatcggcaagaccgtcggcatcggcgcagtcaaatacgccgacttgagcaaaaaccgcaccagcgattatgtgttcgactgggacgccatgctctcatttgaaggcaacaccgccccctacctgcaatacgcctacacccgcgtgcaaagcgtgttccgcaaagccggagaatgggacgcaaccgcaccgaccgttttgaccgaaccactggaaaaacagcttgccgccgagcttctgaaatttgaaaacgtgctgcaaagcgtggcggacaccgcgtatccgcactacctcgccgcctacctttaccaagccgccaccctgttcagccgcttctacgaagcttgcccgattttgaaagccgaaggcgcaagccgcaacagccgcctgcaactggcaaaactcaccggcaacacgctgaaacaaggcttggatttgctgggcatcgatgtgttggacgtaatg

SEQ ID NO: 5698 - protein, 581 aa, Neisseria gonorrhoeae
LNLTERPNFMNLHQTVEHEAAAAFAAAGIAGSPVVLQPTKNAEHGDFQINGVMGAAKKAKQNPRELAQKVADALAGNAVIESAEVAGPGFINLRLRHEFLAQNIHAALNDARFGVAKTAQPQTVVIDYSSPNLAKEMHVGHLRSSIIGDSISRVLEFTGNTVIRQNHVGDWGTQFGMLVAYLVEQQKDNAAFELADLEQFYRAAKVRFDEDPAFADTAREYVVKLQGGDETVLALWKQFVDISLSHAQAVYDTLGLKLRPEDVAGESKYNDDLQPVADDLVQKGLAVEDDGAKVVFLDEFKNKEGEPAAFIVQKQGGGFLYASTDLACLRYRIGRLKAGRLLYVVDHRQALHFEQLFTTSRKAGYLPEDAKAEFIGFGTMMGKDGKPFKTRSGDTVKLVDLLTEAVERATALVKEKNPELGADEAAKIGKTVGIGAVKYADLSKNRTSDYVFDWDAMLSFEGNTAPYLQYAYTRVQSVFRKAGEWDATAPTVLTEPLEKQLAAELLKFENVLQSVADTAYPHYLAAYLYQAATLFSRFYEACPILKAEGASRNSRLQLAKLTGNTLKQGLDLLGIDVLDVM

SEQ ID NO: 5699 - DNA, 1290 bp, Neisseria gonorrhoeae
ttgcacaaacaaccgtttatatatatcataacgaaaaacgccggtgtagctcagtcggtagagcagcgcattcgtaacgcgaatgtcgggggttcgattcccttctccggcaccaataccaagcacagaccctccctcgggaagcctgtgctttttcacatttccgcttcagacggcatccgatatgaactcctcgcaacgcaaacgcctttccggccgctggctcaactcctacgaacgctaccgccaccgccgcctcatacatgccgtgcggctcggcggaaccgtcctgttcgccaccgcactcgcccggctactccacctccaacacggcgaatggatagggatgaccgtcttcgtcgtcctcggcatgctccagttccaaggcgcgatttactccaaggcggtggaacgtatgctcggtacggtcatcgggctgggcgcgggtttgggcgttttatggctgaaccagcattatttccacggcaacctcctcttctacctgaccatcggcacggcaagcgcactggccggctgggcggcggtcggcaaaaacggctacgtccctatgctggcggggctgacgatgtgcatgctcatcggcgacaacggcagcgaatggctcgacagcggcctgatgcgcgcgatgaacgtcctcatcggcgccgccatcgccattgccgccgccaaactgctgccgctgaaatccacactgatgtggcgtttcatgcttgccgacaacctggccgactgcagcaaaatgattgccgaaatcagcaacggcaggcgtatgacgcgcgaacgtttggagcagaatatggtcaaaatgcgccaaatcaacgcacgcatggtcaaaagccgcagccacctcgccgccacatcgggcgaaagccgcatcagcccctccatgatggaagccatgcagcacgcccaccgcaaaatcgtcaacaccaccgagctgctcctgaccaccgccgccaagctgcaatctcccaaactcaacggcagcgaaatccggctgctcgaccgccacttcacactgctccaaaccgacctgcaacaaaccgccgccctcatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgct

SEQ ID NO: 5700 - protein, 430 aa, Neisseria gonorrhoeae
LHKQPFIYIITKNAGVAQSVEQRIRNANVGGSIPFSGTNTKHRPSLGKPVLFHISASDGIRYELLATQTPFRPLAQLLRTLPPPPPHTCRAARRNRPVRHRTRPATPPPTRRMDRDDRLRRPRHAPVPRRDLLQGGGTYARYGHRAGRGFGRFMAEPALFPRQPPLLPDHRHGKRTGRLGGGRQKRLRPYAGGADDVHAHRRQRQRMARQRPDARDERPHRRRHRHCRRQTAAAEIHTDVAFHACRQPGRLQQNDCRNQQRQAYDARTFGAEYGQNAPNQRTHGQKPQPPRRHIGRKPHQPLHDGSHAARPPQNRQHHRAAPDHRRQAAISQTQRQRNPAARPPLHTAPNRPATNRRPHQRQTRPPHPHRHRHQPRTGSPRRTPPLPMAGLPLAQHQYASGNFRPRHPAATHPPQMAGCPRTPTPAPKPA

SEQ ID NO: 5701 - DNA, 606 bp, Neisseria gonorrhoeae; identical to SEQ ID NO: 17

SEQ ID NO: 5702 - protein, 202 aa, Neisseria gonorrhoeae; identical to SEQ ID NO: 18

SEQ ID NO: 5703 - DNA, 804 bp, Neisseria gonorrhoeae
atgccgacagttttcatctttttgacggcggtttacgcaggattgggtgcatttgcatggcactgccaacagcaggggcgcggccgggattacccgtggaagacggaattgccggttttgggcgcggcattgaccgtccacggcgcggcactgctgatgccggtcattcaagacaaaatcatcattatgggcttcgggtattccggcagcctgattgtttggatgatgctgtttatttattttgccggcagctttttttatccgctgcgcggagtgcagttgctgctgtatccttgcgccgcactgatgctgctgtcaggtttggttttcccgggaaaattctcgggatatgaaattaccgactttccctttatgctgcatatcggcacatcactgcttgcatacgggctgttcggcatcgcaacattattgtccgttttgagcttgctgctgcaccggagcctgcaccgcagaaacttctccaagctcgcaggattcctgccgtcgctgctcagtttggaaaaactcatgttccaggccatgtgggcaggtttcatcctgctgacctattccgtcgtcagcggcacattctttgccgaagccgtattcggcaaacccatgacatttacccataaaaccgtattcggcatattgtcatggctgatttacggaggactgctgctcaaacacagcatgaccgcatggcgcggcaaaaaagccgccgtgtggaccatcatcggatttgtcagccttatgattgcctatatgggcagcaagttcgtattggaaatcattctgaaaaga

SEQ ID NO: 5704 - protein, 268 aa, Neisseria gonorrhoeae
MPTVFIFLTAVYAGLGAFAWHCQQQGRGRDYPWKTELPVLGAALTVHGAALLMPVIQDKIIIMGFGYSGSLIVWMMLFIYFAGSFFYPLRGVQLLLYPCAALMLLSGLVFPGKFSGYEITDFPFMLHIGTSLLAYGLFGIATLLSVLSLLLHRSLHRRNFSKLAGFLPSLLSLEKLMFQAMWAGFILLTYSVVSGTFFAEAVFGKPMTFTHKTVFGILSWLIYGGLLLKHSMTAWRGKKAAVWTIIGFVSLMIAYMGSKFVLEIILKR

SEQ ID NO: 5705 - DNA, 105 bp, Neisseria gonorrhoeae
ttgcctatgcctgatgacgaaatttacagactgtacgcggtcaaaccgtattcagccgccaacccacaggggatacatcttgcaaaaacaacagacaaatcaaac

SEQ ID NO: 5706 - protein, 35 aa, Neisseria gonorrhoeae
LPMPDDEIYRLYAVKPYSAANPQGIHLAKTTDKSN

SEQ ID NO: 5707 - DNA, 3228 bp, Neisseria gonorrhoeae
atgatacagaacccgtttcgttgccgtctgaacgcttcagacggcattttatttgcaaaggaattacagggtgcgggcaacttcgacgatgtcgaagcattccagttggtcgccttccatgatttcgttgtagcctttgagcatcagaccgcactcgaagcccatgcggacttcttttacgtcgtctttatagcgtttcaacgaagccagttcgcccgtgtggatgaccacgttgttgcggatgaggcggatatgggaatcgcgtttgaccacgccgtcggtgaccatacagcctgcaatgttgccgaccttggaaacggagatgacctgacggatttcgaccgtaccggtaacctgttctttcttttcgggagaaagcatgccgctcatcgccgccttcacgtcgtcgatggcatcgtagatgatgttgtagtagcggatttccacgttttcattttcggcaagtttgcgcgaagaggcatctgcacgcacgttaaagccgataatgaacgcgcccgaagcgatggcaaggttgacatccgattcggtaatgccgcccacgccgctgtgcaacacgttcactttcacctcgtcggcggacagttttttcaggctgcccgccaaagcctcgtaagagccctgaacgtctgccttgatgatgaccgacaaagattgggcctgggtttcgcccatattgttgaacatattttccagcttcgccgcctgctgtttggcaaggcgcacgtcgcggtatttgccttggcggaagagggcgatttcgcgcgcttttttctcgtccgccaataccatcgcgtcttcacccgcattcggtacgtcggacaagccgaggatttcgacggggatggacgggccggcttcggtaatggatttgccgttttcatcgaccatcgcgcggattttgccgaatgccgtaccggccagcagcatgtcgccttttttcagcgtaccgttttgaaccagcaatgtggcaaccgcgccgcgccctttgtccaaacgcgcctcgacgatgatgcctttggcgggtgcatcgacaggtgcggtcagttccaatacttcggcttcgagcaatacggcttcgagcagcgcgtcgatgttcgttccttttttcgcggaaacgtcgatgaattgaaccgtgccgccccaatcgtcggggatgacttcgtgttgggtcagttcctgacggatgcgttcggggttggcagtgtctttatcgattttattgacggcaaccacaatcggaacgcctgccgctttagcgtgggcaattgcctcgatggtttgcggcatcacgccgtcgtcggcggcgaccacaagaatcacgatatcggttgctttcgcgccgcgcgcgcgcatagcggtaaaggcttcgtggcccggggtgtccaagaaggtaatcacgccgcgcggggttttgacgtggtacgcgccgatgtgctgcgtaatgccgcccgcttcgccctgtaccactttggcgcggcggatgtagtccagcagcgaggttttgccgtggtcgacgtggcccatgacggtaacgacgggcggacgcggcaatgcttcggcttcctccgcttccgcgccctcgcccaagaaggcttcgggatcgtcggcggcggcgggtttgccgatgtgtccgagttttttgacgacaatcagggcggtgtcttggtcgatggattggttgatggtaaccatcatgccctttttcatcagggctttgaccatttccacgcctttgaccgccattttgtgcgccaaatcggcaacggtaatggtttcgggaaccaaaacctcgtgtacgacgggttcggtcggtgcttggaaggcgtgttggttcggctcgagtttgagttttttgcctttcttgccgccgcgtacgcgctcgtcgccgccgttgcgggcattgttgcggtcacgcccgccttttgcacctttgcctttggcgttgcggccttgaccttcgtcatcgcggttgcggcggtcttcttttttcgcttttgccggattgacaggtttgttttcgacggccggtgcggctgcctgcggtttctcggcaggtttggcgggacgctgtctgccggttttggcttcctgtgcggcttttgcctgttgttctgcctgttgtttcatggcttcgcgacgtgcctggcgttcctgtttctctttcaacagggcttcctggtgggcgcgcaatgcggcggcgcggcgcgcctcttcgtcgcgttgcgcctgttcttccgcgctgaccacgggttgcggcacggcaggtgcggcaggtttcgccggttttttggcatctttgcctttgccgtttcgctcgtgtttcggcttgacggctttttctttgggctcggcgggtttggtttccgccgcaacgggtgcggtttcggcttttgcttcggtaggtttctgcgcggcaggtttggctttgttgcctgcttttgccgctttcagttttgccgcttccgcttctgccttggcacgggcttctgcgcgtgcggcagcttcggctcgggcttttaccgcgtcttctgccgtctgctccggctgaacaggtgcggcttgggtttgggcggcttttacttgtgctgccaattcttcggcagaaggaatgttgacagtgcgtccgcgtttgcgtgtttcgacttttacgccgtcaacggtgctgacttcggttttggtgcggcggatgctgatggtgccgccgttgctgccgtttttcttggtcaggtaggcgttcagaagctgtttgtcgtccagcgtcagggaatcgctgccgctgtttttgctgacgccggcttctttcaactgtttcaacaggtcttcgacggggcgtttcagctcggcggcaaattgttctacggttgtgttactcatctgtaccccctttatttgtcttcggtaaaccagtgttcgcgtgcggtcaggatgacggcttttgcagtttcttcgtttacaccggtgatttcaatcagttcgtccacggcaagctctgccaagtcgtcgcgggtggtaatgcctgcttcggcaaggctgaggagcatatcggcatctacgccttcgaggttacgcatatcgtcggacacttcgcccagtttttcttcggcagcaatcgccatggtcaggatggcatcgcgggcacggttgcggagcatatcgacgatttcttcgtcaaatccttcaatggcaagcagttcggcggcaggaaca

SEQ ID NO: 5708 - protein, 1076 aa, Neisseria gonorrhoeae
MIQNPFRCRLNASDGILFAKELQGAGNFDDVEAFQLVAFHDFVVAFEHQTALEAHADFFYVVFIAFQRSQFARVDDHVVADEADMGIAFDHAVGDHTACNVADLGNGDDLTDFDRTGNLFFLFGRKHAAHRRLHVVDGIVDDVVVADFHVFIFGKFARRGICTHVKADNERARSDGKVDIRFGNAAHAAVQHVHFHLVGGQFFQAARQSLVRALNVCLDDDRQRLGLGFAHIVEHIFQLRRLLFGKAHVAVFALAEEGDFARFFLVRQYHRVFTRIRYVGQAEDFDGDGRAGFGNGFAVFIDHRADFAECRTGQQHVAFFQRTVLNQQCGNRAAPFVQTRLDDDAFGGCIDRCGQFQYFGFEQYGFEQRVDVRSFFRGNVDELNRAAPIVGDDFVLGQFLTDAFGVGSVFIDFIDGNHNRNACRFSVGNCLDGLRHHAVVGGDHKNHDIGCFRAARAHSGKGFVARGVQEGNHAARGFDVVRADVLRNAARFALYHFGAADVVQQRGFAVVDVAHDGNDGRTRQCFGFLRFRALAQEGFGIVGGGGFADVSEFFDDNQGGVLVDGLVDGNHHALFHQGFDHFHAFDRHFVRQIGNGNGFGNQNLVYDGFGRCLEGVLVRLEFEFFAFLAAAYALVAAVAGIVAVTPAFCTFAFGVAALTFVIAVAAVFFFRFCRIDRFVFDGRCGCLRFLGRFGGTLSAGFGFLCGFCLLFCLLFHGFATCLAFLFLFQQGFLVGAQCGGAARLFVALRLFFRADHGLRHGRCGRFRRFFGIFAFAVSLVFRLDGFFFGLGGFGFRRNGCGFGFCFGRFLRGRFGFVACFCRFQFCRFRFCLGTGFCACGSFGSGFYRVFCRLLRLNRCGLGLGGFYLCCQFFGRRNVDSASAFACFDFYAVNGADFGFGAADADGAAVAAVFLGQVGVQKLFVVQRQGIAAAVFADAGFFQLFQQVFDGAFQLGGKLFYGCVTHLYPLYLSSVNQCSRAVRMTAFAVSSFTPVISISSSTASSAKSSRVVMPASARLRSISASTPSRLRISSDTSPSFSSAAIAMVRMASRARLRSISTISSSNPSMASSSAAGT

SEQ ID NO: 5709 - DNA, 318 bp, Neisseria gonorrhoeae; identical to SEQ ID NO: 2957

SEQ ID NO: 5710 - protein, 106 aa, Neisseria gonorrhoeae; identical to SEQ ID NO: 2958

SEQ ID NO: 5711 - DNA, 276 bp, Neisseria gonorrhoeae
atgtactgccaagtcggaaataaatgtcttgagaagcaccgggccgaaaacctttatttcagcttggtagtaccaagaatcaaagaaaacggacagataatcaggccggaatataacggcagcatgtggaagatgtcggacggtcagccgctaaggctttcattggcggaatgcagtccgaaagacaacctgcaaagcggtcttgaaacaggccggatagtattcggcgtcctcgcgtccgtttactttgtttccctgctgaaaaaggttttgaaa

SEQ ID NO: 5712 - protein, 92 aa, Neisseria gonorrhoeae
MYCQVGNKCLEKHRAENLYFSLVVPRIKENGQIIRPEYNGSMWKMSDGQPLRLSLAECSPKDNLQSGLETGRIVFGVLASVYFVSLLKKVLK

SEQ ID NO: 5713 - DNA, 594 bp, Neisseria gonorrhoeae; identical to SEQ ID NO: 97

SEQ ID NO: 5714 - protein, 198 aa, Neisseria gonorrhoeae; identical to SEQ ID NO: 98

SEQ ID NO: 5715 - DNA, 138 bp, Neisseria gonorrhoeae
ttgcggacaacagccctgcaatcaaccggcggaccatcctcatccgaatctgaaaaaagcggcgcgatacaccgtatccgccgcccctcccaaaatgcgaaacagacaaacgccaagcaagcaagcaagcaaaaatta

SEQ ID NO: 5716 - protein, 46 aa, Neisseria gonorrhoeae
LRTTALQSTGGPSSSESEKSGAIHRIRRPSQNAKQTNAKQASKQKL

SEQ ID NO: 5717 - DNA, 153 bp, Neisseria gonorrhoeae
gtgcgcgcccctgccgcaccgtgccgcgcttttgcgcccggacggcatcgttccgccatccggttctctgtttcaaatacccctgtttcagaaagaaatgcagatgtttcaacacacaggacgacatataaagtaccgccctatgtgtcgtcc

SEQ ID NO: 5718 - protein, 51 aa, Neisseria gonorrhoeae
VRAPAAPCRAFAPGRHRSAIRFSVSNTPVSERNADVSTHRTTYKVPPYVSS

SEQ ID NO: 5719 - DNA, 165 bp, Neisseria gonorrhoeae
atgtcgtcctgtgtgttgaaacatctgcatttctttctgaaacaggggtatttgaaacagagaaccggatggcggaacgatgccgtccgggcgcaaaagcgcggcacggtgcggcaggggcgcgcacgcgtgttgagggaaggaaaacagggaaaggaggcgggc

SEQ ID NO: 5720 - protein, 55 aa, Neisseria gonorrhoeae
MSSCVLKHLHFFLKQGYLKQRTGWRNDAVRAQKRGTVRQGRARVLREGKQGKEAG

SEQ ID NO: 5721 - DNA, 1080 bp, Neisseria gonorrhoeae
ttgaaagcccgccctcggataccagctgaagcggtcgtaaagcgaactacccgcgccgtgcatcgcaaaggtggcgtaaccttcttgtttcaaacggttggggaggcagcgggcaaatttttcgtcgggcgcgcggcgcagtgcgaacccgcgcaaaccgccgtaggcgcacaattcgcgcatttcgccttcgaccgtcgcgccgatgaagggaaaactgccgctttcccaaaccgaaaaacggtctttttgcgccagcagtttggcaaaagtggcgttttgaagctcgggattgcccggcagcccccaagattcggcgacgataaagaggattttttgagatttcggctcactcagccgcgtggcggcacgctgctgattgcccaaggggaggaagacggggtcgaccaggccggcggtaataaagtcggcattctggctgacggtgtagagcatcgcctgacttttggcgtaatagaagttgtttgcgccgaagatattggccatccgcccccggtcgtagtaactcaaatggccggtgaaatagccggctgccgccacaacggcggcacagacggcaatgtgtcggaagtcggttttgacggcggctttttgcaacacaaacggcatcgccagcatatacagcagcaacagcccggtcattatctgataaggggcgggggcggtcaggatgaaggggacgaggttgatggcgccgatgaggtccataaaagggaagagttggatcaccatcatcagcccgtcaaacaaaaccgccggccaaaacgccaatacgccggcaattttgacgaaacgccaaggcagggcgatcagcagcgcggcgggaaggtagtccaaattgacaatcgggcgggcggtggcggtcagcagtgccaaaacccaaaacaccgcattgggggccagcagtatcagcagggacagcagcagccgtttcggcaggaatggcggcagcgtccattgttcggagagcagggcgtgaatattcatcgtatttccttttcggttgaaaccccgccactcggacatctgtccttcggggcggcaggatcagactatatt

SEQ ID NO: 5722 - protein, 360 aa, Neisseria gonorrhoeae
LKARPRIPAEAVVKRTTRAVHRKGGVTFLFQTVGEAAGKFFVGRAAQCEPAQTAVGAQFAHFAFDRRADEGKTAAFPNRKTVFLRQQFGKSGVLKLGIARQPPRFGDDKEDFLRFRLTQPRGGTLLIAQGEEDGVDQAGGNKVGILADGVEHRLTFGVIEVVCAEDIGHPPPVVVTQMAGEIAGCRHNGGTDGNVSEVGFDGGFLQHKRHRQHIQQQQPGHYLIRGGGGQDEGDEVDGADEVHKREELDHHHQPVKQNRRPKRQYAGNFDETPRQGDQQRGGKVVQIDNRAGGGGQQCQNPKHRIGGQQYQQGQQQPFRQEWRQRPLFGEQGVNIHRISFSVETPPLGHLSFGAAGSDYI

SEQ ID NO: 5723 - DNA, 1176 bp, Neisseria gonorrhoeae
atgtccgagtggcggggtttcaaccgaaaaggaaatacgatgaatattcacgccctgctctccgaacaatggacgctgccgccattcctgccgaaacggctgctgctgtccctgctgatactgctggcccccaatgcggtgttttgggttttggcactgctgaccgccaccgcccgcccgattgtcaatttggactaccttcccgccgcgctgctgatcgccctgccttggcgtttcgtcaaaattgccggcgtattggcgttttggccggcggttttgtttgacgggctgatgatggtgatccaactcttcccttttatggacctcatcggcgccatcaacctcgtccccttcatcctgaccgcccccgccccttatcagataatgaccgggctgttgctgctgtatatgctggcgatgccgtttgtgttgcaaaaagccgccgtcaaaaccgacttccgacacattgccgtctgtgccgccgttgtggcggcagccggctatttcaccggccatttgagttactacgaccgggggcggatggccaatatcttcggcgcaaacaacttctattacgccaaaagtcaggcgatgctctacaccgtcagccagaatgccgactttattaccgccggcctggtcgaccccgtcttcctccccttgggcaatcagcagcgtgccgccacgcggctgagtgagccgaaatctcaaaaaatcctctttatcgtcgccgaatcttgggggctgccgggcaatcccgagcttcaaaacgccacttttgccaaactgctggcgcaaaaagaccgtttttcggtttgggaaagcggcagttttcccttcatcggcgcgacggtcgaaggcgaaatgcgcgaattgtgcgcctacggcggtttgcgcgggttcgcactgcgccgcgcgcccgacgaaaaatttgcccgctgcctccccaaccgtttgaaacaagaaggttacgccacctttgcgatgcacggcgcgggtagttcgctttacgaccgcttcagctggtatccgagggcgggctttcaaaaaatcaaaaccgccgaaaacctgatcggtaaaaaacctgcgccattttcggcggcgtgtgcgacagcgagctgttcggcgaagtgtcggcatttttcaaaaaacacgacaagggactgttttactgga

SEQ ID NO: 5724 - protein, 392 aa, Neisseria gonorrhoeae
MSEWRGFNRKGNTMNIHALLSEQWTLPPFLPKRLLLSLLILLAPNAVFWVLALLTATARPIVNLDYLPAALLIALPWRFVKIAGVLAFWPAVLFDGLMMVIQLFPFMDLIGAINLVPFILTAPAPYQIMTGLLLLYMLAMPFVLQKAAVKTDFRHIAVCAAVVAAAGYFTGHLSYYDRGRMANIFGANNFYYAKSQAMLYTVSQNADFITAGLVDPVFLPLGNQQRAATRLSEPKSQKILFIVAESWGLPGNPELQNATFAKLLAQKDRFSVWESGSFPFIGATVEGEMRELCAYGGLRGFALRRAPDEKFARCLPNRLKQEGYATFAMHGAGSSLYDRFSWYPRAGFQKIKTAENLIGKKPAPFSAACATASCSAKCRHFSKNTTRDCFTG

SEQ ID NO: 5725 - DNA, 351 bp, Neisseria gonorrhoeae
gtgtgcgacagcgagctgttcggcgaagtgtcggcatttttcaaaaaacacgacaagggactgttttactggatgacgctgaccagccacgccgactatcccgaatccgacattttcaaccacaggctcaaatgcaccgaatacggcctgcccgccgaaaccgacctctgccgcaatttcagcctgcacacccaattcttcgaccaactggcggatttgatccgacgccccgaaatgaaaggcacggaagtcatcatcgtcggcgaccatccgccgcccgtcggcaacctcaatgaaaccttccgctacctcaaacagggacacgtcgcctggctgcacttcaaaatcaaa

SEQ ID NO: 5726 - protein, 117 aa, Neisseria gonorrhoeae
VCDSELFGEVSAFFKKHDKGLFYWMTLTSHADYPESDIFNHRLKCTEYGLPAETDLCRNFSLHTQFFDQLADLIRRPEMKGTEVIIVGDHPPPVGNLNETFRYLKQGHVAWLHFKIK

SEQ ID NO: 5727 - DNA, 417 bp, Neisseria gonorrhoeae
ttgttgttatttgattttgaagtgcagccaggcgacgtgtccctgtttgaggtagcggaaggtttcattgaggttgccgacgggcggcggatggtcgccgacgatgatgacttccgtgcctttcatttcggggcgtcggatcaaatccgccagttggtcgaagaattgggtgtgcaggctgaaattgcggcagaggtcggtttcggcgggcaggccgtattcggtgcatttgagcctgtggttgaaaatgtcggattcgggatagtcggcgtggctggtcagcgtcatccagtaaaacagtcccttgtcgtgttttttgaaaaatgccgacacttcgccgaacagctcgctgtcgcacacgccgccgaaaatggcgcaggttttttaccgatcaggttttcggcggttttgattttt

SEQ ID NO: 5728 - protein, 139 aa, Neisseria gonorrhoeae
LLLFDFEVQPGDVSLFEVAEGFIEVADGRRMVADDDDFRAFHFGASDQIRQLVEELGVQAEIAAEVGFGGQAVFGAFEPVVENVGFGIVGVAGQRHPVKQSLVVFFEKCRHFAEQLAVAHAAENGAGFLPIRFSAVLIF

SEQ ID NO: 5729 - DNA, 258 bp, Neisseria gonorrhoeae
atgccgtctgaacgcaccaacagccttcagacggcattttgcagacagaccgacctcctcaagcccacttttttcatcatctccgataaattgctttgtaagaatccaaaaatccaaaatcacaggaagttatcaaaaaaacagaaaccatccgccgtcgttcccgcgaaagcgggaatccagacccggaaaccgcagaaatttatcggaaaaaccgaaactcgaaaacaacggacagaattcccgcctgcgcaggaa

SEQ ID NO: 5730 - protein, 86 aa, Neisseria gonorrhoeae
MPSERTNSLQTAFCRQTDLLKPTFFIISDKLLCKNPKIQNHRKLSKKQKPSAVVPAKAGIQTRKPQKFIGKTETRKQRTEFPPAQE

SEQ ID NO: 5731 - DNA, 1227 bp, Neisseria gonorrhoeae
atgtcgggggttcgattcccttctccggcaccaataccaagcacagaccctccctcgggaagcctgtgctttttcacatttccgcttcagacggcatccgatatgaactcctcgcaacgcaaacgcctttccggccgctggctcaactcctacgaacgctaccgccaccgccgcctcatacatgccgtgcggctcggcggaaccgtcctgttcgccaccgcactcgcccggctactccacctccaacacggcgaatggatagggatgaccgtcttcgtcgtcctcggcatgctccagttccaaggcgcgatttactccaaggcggtggaacgtatgctcggtacggtcatcgggctgggcgcgggtttgggcgttttatggctgaaccagcattatttccacggcaacctcctcttctacctgaccatcggcacggcaagcgcactggccggctgggcggcggtcggcaaaaacggctacgtccctatgctggcggggctgacgatgtgcatgctcatcggcgacaacggcagcgaatggctcgacagcggcctgatgcgcgcgatgaacgtcctcatcggcgccgccatcgccattgccgccgccaaactgctgccgctgaaatccacactgatgtggcgtttcatgcttgccgacaacctggccgactgcagcaaaatgattgccgaaatcagcaacggcaggcgtatgacgcgcgaacgtttggagcagaatatggtcaaaatgcgccaaatcaacgcacgcatggtcaaaagccgcagccacctcgccgccacatcgggcgaaagccgcatcagcccctccatgatggaagccatgcagcacgcccaccgcaaaatcgtcaacaccaccgagctgctcctgaccaccgccgccaagctgcaatctcccaaactcaacggcagcgaaatccggctgctcgaccgccacttcacactgctccaaaccgacctgcaacaaaccgccgccctcatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacggc

SEQ ID NO: 5732 - protein, 409 aa, Neisseria gonorrhoeae
MSGVRFPSPAPIPSTDPPSGSLCFFTFPLQTASDMNSSQRKRLSGRWLNSYERYRHRRLIHAVRLGGTVLFATALARLLHLQHGEWIGMTVFVVLGMLQFQGAIYSKAVERMLGTVIGLGAGLGVLWLNQHYFHGNLLFYLTIGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEQNMVKMRQINARMVKSRSHLAATSGESRISPSMMEAMQHAHRKIVNTTELLLTTAAKLQSPKLNGSEIRLLDRHFTLLQTDLQQTAALINGRHARRIRIDTAINPELEALAEHLHYQWQGFLWLSTNMRQEISALVILLQRTRRKWLDAHERQHLRQSLLETREHG

SEQ ID NO: 5733 - DNA, 96 bp, Neisseria gonorrhoeae
ttggagtcatatcaacaaaaagctgcccgggtattcatttggggcggcttttttgtggcaaaatttaaattcaaagagaaaacgccctatgccgtc

SEQ ID NO: 5734 - protein, 32 aa, Neisseria gonorrhoeae
LESYQQKAARVFIWGGFFVAKFKFKEKTPYAV

SEQ ID NO: 5735 - DNA, 120 bp, Neisseria gonorrhoeae
ttgtggcaaaatttaaattcaaagagaaaacgccctatgccgtctgaaagtctttcagacggcatctgtcagcctcacgcaagagggaatcccagctgtttggtttcaattttttttggg

SEQ ID NO: 5736 - protein, 40 aa, Neisseria gonorrhoeae
LWQNLNSKRKRPMPSESLSDGICQPHARGNPSCLVSIFFG

SEQ ID NO: 5737 - DNA, 705 bp, Neisseria gonorrhoeae
atgtttctttacggcgcactgacgaccttggggctgacggtcgtggcgacggcgggcggttcggtattgggtctgttgttggcgttggcgcgcctgattcacttggaaaaagccggtgcgccgatgcgcgtgctggcgtgggcgttgcgtaaggtttcgctgctgtacgttaccctgttccggggtacgccgctgtttgtgcagattgtgatttgggcgtatgtgtggtttccgtttttcgtccatccttcagacggcattttggtcagcggcgaggcggcaatcgcgctgcgtcgcggatacgggccgctgattgccggttctttggcactgatcgccaactcgggggcgtatatctgtgagattttccgcgcgggcatccagtctatagacaaaggacagatggaggcggcgtgttctttgggactgacctatccgcaggcgatgcgctatgtgattctgccgcaggcattgcgccgtatgctgccgcctttggcgagcgagttcatcacgctcttgaaagacagctcgctgctgtcggtcattgctgtggcggagttggcgtatgttcagaatacgattacgggccggtattcggtttatgaagaaccgctttacaccgccgccctgatttatctgttgatgacgactttcttaggctggatattcctgcgtttggaaaaacgttacaatccgcaacaccgc

SEQ ID NO: 5738 - protein, 235 aa, Neisseria gonorrhoeae
MFLYGALTTLGLTVVATAGGSVLGLLLALARLIHLEKAGAPMRVLAWALRKVSLLYVTLFRGTPLFVQIVIWAYVWFPFFVHPSDGILVSGEAAIALRRGYGPLIAGSLALIANSGAYICEIFRAGIQSIDKGQMEAACSLGLTYPQAMRYVILPQALRRMLPPLASEFITLLKDSSLLSVIAVAELAYVQNTITGRYSVYEEPLYTAALIYLLMTTFLGWIFLRLEKRYNPQHR

SEQ ID NO: 5739 - DNA, 114 bp, Neisseria gonorrhoeae
atggcggattattttgcaacggcggcagttccgccggtttttgatacggacggtttatggattttcgttttgacattatttacgaataccgctggatgtttctttacggcgcac

SEQ ID NO: 5740 - protein, 38 aa, Neisseria gonorrhoeae
MADYFATAAVPPVFDTDGLWIFVLTLFTNTAGCFFTAH

SEQ ID NO: 5741 - DNA, 846 bp, Neisseria gonorrhoeae
ttgcaaaataatccgccattttaccgtaaaaaccgccgcctgaacttttttatcgcggcagacggcggttgcgcgtctccgcaaaaatgcagggcgcgcggttttcagacggcatttgccgttcaaggccgtgcggtgtctttaccaaatgcccaaccattcgcccacggaatccatccaatccttattgcccccgccgctcctgcctgcccggcggtacgcccacggcgcttgcggatttttagctttccacaatcctttgcgttccctttccgcctgaatttgagcgtcggcatagtcggcaaaatccgccttatcctgctgttctttagcataacttttataatgccacgccgccccgtcctgcacctgcatcaggttcaaatcggttttgccggcggatacctgcgccacttcgcgctgatagcggtcggtttcaaacacacgtacactgactttcctaccctccgccgccgcgcgcaggttgtcgcgcgaacgtgtaccgtaagcctgtttcatctccggtgcgtcgatatacgccatccgaattttatgtttcgcgccgtcgccgtcgatgacgtgaagggtatcgccgtcatagactttggacaccgtgcctgtgtagctgtggccggatttcgccgatgcccgtcggcgaacgggcgcgtcgaaacccacgtcccctgcagtgccgagtacgtcgagtacggcaaccgccgtccgcaccgcctcactgtcatatcccgtataacccaacgcgcccaaaagcgacagggcgacgggaagccatttcatgatttttttaatctgcatatttttcaaatgccgatgccgtctgaacatctc

SEQ ID NO: 5742 - protein, 282 aa, Neisseria gonorrhoeae
LQNNPPFYRKNRRLNFFIAADGGCASPQKCRARGFQTAFAVQGRAVSLPNAQPFAHGIHPILIAPAAPACPAVRPRRLRIFSFPQSFAFPFRLNLSVGIVGKIRLILLFFSITFIMPRRPVLHLHQVQIGFAGGYLRHFALIAVGFKHTYTDFPTLRRRAQVVARTCTVSLFHLRCVDIRHPNFMFRAVAVDDVKGIAVIDFGHRACVAVAGFRRCPSANGRVETHVPCSAEYVEYGNRRPHRLTVISRITQRAQKRQGDGKPFHDFFNLHIFQMPMPSEHL

SEQ ID NO: 5743 - DNA, 108 bp, Neisseria gonorrhoeae
gtgcgaaagtcatctatccctgccaagggtaatcctgacgttaagatgccgtctgaaatccggttcagagatgttcagacggcatcggcatttgaaaaatatgcagat

SEQ ID NO: 5744 - protein, 36 aa, Neisseria gonorrhoeae
VRKSSIPAKGNPDVKMPSEIRFRDVQTASAFEKYAD

SEQ ID NO: 5745 - DNA, 678 bp, Neisseria gonorrhoeae
ttgaaaaatatgcagattaaaaaaatcatgaaatggcttcccgtcgccctgtcgcttttgggcgcgttgggttatacgggatatgacagtgaggcggtgcggacggcggttgccgtactcgacgtactcggcactgcaggggacgtgggtttcgacgcgcccgttcgccgacgggcatcggcgaaatccggccacagctacacaggcacggtgtccaaagtctatgacggcgatacccttcacgtcatcgacggcgacggcgcgaaacataaaattcggatggcgtatatcgacgcaccggagatgaaacaggcttacggtacacgttcgcgcgacaacctgcgcgcggcggcggagggtaggaaagtcagtgtacgtgtgtttgaaaccgaccgctatcagcgcgaagtggcgcaggtatccgccggcaaaaccgatttgaacctgatgcaggtgcaggacggggcggcgtggcattataaaagttatgctaaagaacagcaggataaggcggattttgccgactatgccgacgctcaaattcaggcggaaagggaacgcaaaggattgtggaaagctaaaaatccgcaagcgccgtgggcgtaccgccgggcaggcaggagcggcgggggcaataaggattggatggattccgtgggcgaatggttgggcatttgg

SEQ ID NO: 5746 - protein, 226 aa, Neisseria gonorrhoeae
LKNMQIKKIMKWLPVALSLLGALGYTGYDSEAVRTAVAVLDVLGTAGDVGFDAPVRRRASAKSGHSYTGTVSKVYDGDTLHVIDGDGAKHKIRMAYIDAPEMKQAYGTRSRDNLRAAAEGRKVSVRVFETDRYQREVAQVSAGKTDLNLMQVQDGAAWHYKSYAKEQQDKADFADYADAQIQAERERKGLWKAKNPQAPWAYRRAGRSGGGNKDWMDSVGEWLGIW

SEQ ID NO: 5747 - DNA, 552 bp, Neisseria gonorrhoeae
ttgggcaaaagcggtaaaaaaatcaaaggcgcggtttcaacctccaaaaaatccggcgaactgcttgcccggtacgacattcccgtcgtgtccctgaacgaagtgtccggtttggcggtctatatcgacggtgcggacgaagtgaaccacgccctgcaaatgattaagggcggcggcggcgcgcacctcaacgaaaaaatcgtcgccagcgcatcagaaaaattcgtctgcattgcggacgaaagcaaatatgtttcccggctgggcaaattcccactgcccgtggaagccgtcgaaagcgcgcgctcccttgtttcgcgcaaactgcttgccatgggcggacagcccgaactgcgtatcggctacaccacgttttacggcaaccaaatcgtcgatgtccacggcttgaatatcgatcagccgctgacgatggaagatgaaatcaacaaaatcaccggcgtactcgaaaacggcatattcgcccgcgatgccgccgatgtgttgattttggggacggaagagggtgcgaaagtcatctatccctgccaaggg

SEQ ID NO: 5748 - protein, 184 aa, Neisseria gonorrhoeae
LGKSGKKIKGAVSTSKKSGELLARYDIPVVSLNEVSGLAVYIDGADEVNHALQMIKGGGGAHLNEKIVASASEKFVCIADESKYVSRLGKFPLPVEAVESARSLVSRKLLAMGGQPELRIGYTTFYGNQIVDVHGLNIDQPLTMEDEINKITGVLENGIFARDAADVLILGTEEGAKVIYPCQG

SEQ ID NO: 5749 - DNA, 663 bp, Neisseria gonorrhoeae; identical to SEQ ID NO: 289

SEQ ID NO: 5750 - protein, 221 aa, Neisseria gonorrhoeae; identical to SEQ ID NO: 290

SEQ ID NO: 5751 - DNA, 90 bp, Neisseria gonorrhoeae
ttgtgtgccggacagcatatcggcaaatccgtcaaggcttgcccgaaacggggattttacaattccaacgttaaaagttccaatatttca

SEQ ID NO: 5752 - protein, 30 aa, Neisseria gonorrhoeae
LCAGQHIGKSVKACPKRGFYNSNVKSSNIS

SEQ ID NO: 5753 - DNA, 522 bp, Neisseria gonorrhoeae
atgccgtctgaaattcaattcaaaacatcaggaacacaaacgatgacgaatatccgtatcggacagggctacgatgtccaccaattgaccgaaggcagaaagctgatacttggcggagttgaaatcccatttgaaaaagggctgctcgggcattcggatgccgacgcgctgctgcacgccgttaccgacgcgctgctcggtgcggcaggtttgggcgacatcggcagccattttcccgacaccgccgcagagttcaaagatgcggacagccgcgtccttttgcgtgcggcgtatcaaagcgttcaggcgcagggttggcaggtggtcaatgtcgatacgaccgtgattgcacagaaacccaaactcgcaccgcacattccgcaaatgcgtgccaacatcgccgccgatttgggtatcgatatttcgtgcgtcaatatcaaaggcaaaaccaacgaaaaactcggctatctcgggcggatggaaggcatagaggcgcaggcggcggtattgctggtacggatt

SEQ ID NO: 5754 - protein, 174 aa, Neisseria gonorrhoeae
MPSEIQFKTSGTQTMTNIRIGQGYDVHQLTEGRKLILGGVEIPFEKGLLGHSDADALLHAVTDALLGAAGLGDIGSHFPDTAAEFKDADSRVLLRAAYQSVQAQGWQVVNVDTTVIAQKPKLAPHIPQMRANIAADLGIDISCVNIKGKTNEKLGYLGRMEGIEAQAAVLLVRI

SEQ ID NO: 5755 - DNA, 687 bp, Neisseria gonorrhoeae
atgaaacgcaaaaatatcgcgctgattcccgccgccggcatcggggtgcgtttcggtgcggacaaacccaagcaatatgtcgaaatcggaagcaaaaccgttttagaacatgtacttgggatttttgaacggcatgaggccgtcgatttgaccgtcgttgtcgtctcgcccgaagacacgtttgccgataaggttcagacggcatttccacaggttcgggtgtggaaaaacggtggacagacccgcgccgaaactgtccgcaacggtgtggcaaaactgttggaaaccggtttggcggcggaaaccgacaatattctggtacacgatgccgcccgctgctgcctgccgtctgaagctctggcgcggttgatagaacaggcgggcaacgccgccgaaggcgggattttggcagttcccgttgccgatacgctcaagcgcgcagaaagcggacaaatcagtgcaactgtcgaccgttcggggctttggcaggcgcaaacgccgcagctttttcaagcgggtttgctgcaccgcgcattggctgcggaaaacttgggcggcattaccgatgaagcgtccgccgtggaaaaactgggtgtgcgtccgctactgatacagggcgacgcgcgcaatttgaaactgacgcagccgcaggacgcatacatcgtcaggctgctgctcaatgccgtc

SEQ ID NO: 5756 - protein, 229 aa, Neisseria gonorrhoeae
MKRKNIALIPAAGIGVRFGADKPKQYVEIGSKTVLEHVLGIFERHEAVDLTVVVVSPEDTFADKVQTAFPQVRVWKNGGQTRAETVRNGVAKLLETGLAAETDNILVHDAARCCLPSEALARLIEQAGNAAEGGILAVPVADTLKRAESGQISATVDRSGLWQAQTPQLFQAGLLHRALAAENLGGITDEASAVEKLGVRPLLIQGDARNLKLTQPQDAYIVRLLLNAV

SEQ ID NO: 5757 - DNA, 1029 bp, Neisseria gonorrhoeae
ttgccacaccgttgcggacagtttcggcgcgggtctgtccaccgtttttccacacccgaacctgtggaaatgccgtctgaaccttatcggcaaacgtgtcttcgggcgagacgacaacgacggtcaaatcgacggcctcatgccgttcaaaaatcccaagtacatgttctaaaacggttttgcttccgatttcgacatattgcttgggtttgtccgcaccgaaacgcaccccgatgccggcggcgggaatcagcgcgatatttttgcgtttcatgcgttttccccgccgttttcagacggcacggcttccttacgccaaatacaggcttcgcccaagccgtcgagatattcttcgtgcgccgccagttcggcttcatccgccttaatcactttcagtttggcaccgagtttcatttcggcagatgcaacaggtttggctgtcggttcttcctcctcggtctcccccatcaagtcgaattgccgccgcgtcatcgccagatagacttcgcccaaaagttcgcagtcgatcaatgcgccgtgcaggacgcgcttgctgcggtcgacggaaaaacggttgcacagggcatccaggctcgctttctgccccggaaacatttcgcgcgccatcgccagggtatcggtaacggtgcagccgagttcctcgacggtcggcagccccacccggcggaactccatattgaggaagcccacatcgaatttggcattgtggataatcagttccgcaccgcgcagaaaatcggcaatctgcctgccgacctctgcaaacggcggcgcgtttttctcttccaaaacctgtatcgtcaagccgtggacgcgtgccgcctcttcgggcatatcgcgctcggggtggacatagaggtgcaggtttttgtcggtcatttggcggttgaccatttccagaccggcaaactcgaccagacggtcgccgccgtcggcatacaggccggtggtttcggtatcgaggatgatttggcgtgtcatcatatcggtgtctttcttctgtcttcg

SEQ ID NO: 5758 - protein, 343 aa, Neisseria gonorrhoeae
LPHRCGQFRRGSVHRFSTPEPVEMPSEPYRQTCLRARRQRRSNRRPHAVQKSQVHVLKRFCFRFRHIAWVCPHRNAPRCRRRESARYFCVSCVFPAVFRRHGFLTPNTGFAQAVEIFFVRRQFGFIRLNHFQFGTEFHFGRCNRFGCRFFLLGLPHQVELPPRHRQIDFAQKFAVDQCAVQDALAAVDGKTVAQGIQARFLPRKHFARHRQGIGNGAAEFLDGRQPHPAELHIEEAHIEFGIVDNQFRTAQKIGNLPADLCKRRRVFLFQNLYRQAVDACRLFGHIALGVDIEVQVFVGHLAVDHFQTGKLDQTVAAVGIQAGGFGIEDDLACHHIGVFLLSS

SEQ ID NO: 5759 - DNA, 732 bp, Neisseria gonorrhoeae
atgatgacacgccaaatcatcctcgataccgaaaccaccggcctgtatgccgacggcggcgaccgtctggtcgagtttgccggtctggaaatggtcaaccgccaaatgaccgacaaaaacctgcacctctatgtccaccccgagcgcgatatgcccgaagaggcggcacgcgtccacggcttgacgatacaggttttggaagagaaaaacgcgccgccgtttgcagaggtcggcaggcagattgccgattttctgcgcggtgcggaactgattatccacaatgccaaattcgatgtgggcttcctcaatatggagttccgccgggtggggctgccgaccgtcgaggaactcggctgcaccgttaccgataccctggcgatggcgcgcgaaatgtttccggggcagaaagcgagcctggatgccctgtgcaaccgtttttccgtcgaccgcagcaagcgcgtcctgcacggcgcattgatcgactgcgaacttttgggcgaagtctatctggcgatgacgcggcggcaattcgacttgatgggggagaccgaggaggaagaaccgacagccaaacctgttgcatctgccgaaatgaaactcggtgccaaactgaaagtgattaaggcggatgaagccgaactggcggcgcacgaagaatatctcgacggcttgggcgaagcctgtatttggcgtaaggaagccgtgccgtctgaaaacggcggggaaaacgca

SEQ ID NO: 5760 - protein, 244 aa, Neisseria gonorrhoeae
MMTRQIILDTETTGLYADGGDRLVEFAGLEMVNRQMTDKNLHLYVHPERDMPEEAARVHGLTIQVLEEKNAPPFAEVGRQIADFLRGAELIIHNAKFDVGFLNMEFRRVGLPTVEELGCTVTDTLAMAREMFPGQKASLDALCNRFSVDRSKRVLHGALIDCELLGEVYLAMTRRQFDLMGETEEEEPTAKPVASAEMKLGAKLKVIKADEAELAAHEEYLDGLGEACIWRKEAVPSENGGENA

SEQ ID NO: 5761 - DNA, 1329 bp, Neisseria gonorrhoeae
ttgaaaaagagaaggaaaacgatggacgctaaaaaaggcggtttgggactggttaaaagccgccgtttcgggcctcttttcgctacgcagtttctcggcgcgttcaatgacaatgtgttcaaaaccgcgctgtttgtcatgatcgggttttacggtttggggcaaaacggcttcctgcctgccggacagatgttgaacttgggcgcactgctgtttattttgccgtatttcctgttttccgcgctgtcggggcagttgggtaacaaattcgacaaggccgttttggcgcgttgggtcaaggtgctggaaatcatcattatggcggtggcggcatacgggttttatatccggtcagccccgctgctcttgctctgcctgttttgcatgggcgcgcaatcgacgctgttcggcccgcttaaatatgccattctgcccgattatctcgacgacaacgagctgatgatgggcaacagcctgattgaatccggtacgtttgtcgccatcctgtttggtcagattttgggaacggcggttgccggcgcgccgccttatattgtcgggatactggttttgctggtcgccgtcggaggaacggccggcagcctgtttatgccgtccgtacccgccaaggctgccgatacccaaatcgagtggaatattgtccgtggtacaaaatccctgctgcgtgaaacggtgcggcacaatcccgtttttaccgccattatcggcatctcgtggttttggtttgtcggcgcggtttataccacgcaactgccgacctttacccaaatccatttgggcggcaacgataatgtttttaacctgatgcttgctttgttttccatcggtattgccgccggttcggtactgtgtgccaagttcggcagggaacggctgatgttggcttgggtaacggttggtgcgttgggtttgacggtttgcggcctggttttggtgtggctgacgcacggacaccgttttgaagggctgaacggcattttttggtttttatcgcaaggatgggcataccccgtgatggcggtgatgacgctgatcggctttttcggcggatttttctccgttccgctctatacctggctgcaaaccgccagcagcgagactttccgcgcccgcgccgttgccgccaacaatatcgttaacggcatctttatggtttccgccgccgttttgagcgcggtattgctgtttttgtttgacagcatttccctgctgtatctgattgtcgccttgggcaatattccgttggcggtatttttgattaagcgcgaaaggcggtttttaggcgcggcggcaatcaggaaaaaacct

SEQ ID NO: 5762 - protein, 443 aa, Neisseria gonorrhoeae
LKKRRKTMDAKKGGLGLVKSRRFGPLFATQFLGAFNDNVFKTALFVMIGFYGLGQNGFLPAGQMLNLGALLFILPYFLFSALSGQLGNKFDKAVLARWVKVLEIIIMAVAAYGFYIRSAPLLLLCLFCMGAQSTLFGPLKYAILPDYLDDNELMMGNSLIESGTFVAILFGQILGTAVAGAPPYIVGILVLLVAVGGTAGSLFMPSVPAKAADTQIEWNIVRGTKSLLRETVRHNPVFTAIIGISWFWFVGAVYTTQLPTFTQIHLGGNDNVFNLMLALFSIGIAAGSVLCAKFGRERLMLAWVTVGALGLTVCGLVLVWLTHGHRFEGLNGIFWFLSQGWAYPVMAVMTLIGFFGGFFSVPLYTWLQTASSETFRARAVAANNIVNGIFMVSAAVLSAVLLFLFDSISLLYLIVALGNIPLAVFLIKRERRFLGAAAIRKKP

SEQ ID NO: 5763 - DNA, 105 bp, Neisseria gonorrhoeae
atgctgtccggcacacaagccgcatcaaattattttgattttattttaacaaagaatgcccctgatggggcaagctattcttattcagaccaaggaccagtatgt

SEQ ID NO: 5764 - protein, 35 aa, Neisseria gonorrhoeae
MLSGTQAASNYFDFILTKNAPDGASYSYSDQGPVC

SEQ ID NO: 5765 - DNA, 90 bp, Neisseria gonorrhoeae
atgaagatgctttcgggtatggatttattgggcggacagggttgtatttttcgccaaagaggcaagcctgcggcttgcttgccctctccc

SEQ ID NO: 5766 - protein, 30 aa, Neisseria gonorrhoeae
MKMLSGMDLLGGQGCIFRQRGKPAACLPSP

SEQ ID NO: 5767 - DNA, 186 bp, Neisseria gonorrhoeae
gtgatggaaagtatgtttattctggtgcccatcagcattattttggcatttgtcatcggctggtttttctggtggtcgggcaaaaacggacagtttgacgatttggaaggaccggcgcaccgcattttgatggatgatgattcgacaagtaaactgattgaaaaagagaaggaaaacgatggacgc

SEQ ID NO: 5768 - protein, 62 aa, Neisseria gonorrhoeae
VMESMFILVPISIILAFVIGWFFWWSGKNGQFDDLEGPAHRILMDDDSTSKLIEKEKENDGR

SEQ ID NO: 5769 - DNA, 186 bp, Neisseria gonorrhoeae
ttggaagatgggacgggcaaccatgtcctgtcgccgttcggtcagacggaaattccccaatattggcgcgtggtcaaagaccgtatcgagctgttttttgacgaagcccccgtcggaactttgcgtaacgaatatctgaccgtgtcagggcagacttttgttttgaacgatttgatagggaatatg

SEQ ID NO: 5770 - protein, 62 aa, Neisseria gonorrhoeae
LEDGTGNHVLSPFGQTEIPQYWRVVKDRIELFFDEAPVGTLRNEYLTVSGQTFVLNDLIGNM

SEQ ID NO: 5771 - DNA, 171 bp, Neisseria gonorrhoeae
atggttgcccgtcccatcttccaatttaacggcaaaacgcccgctctgcagccgtgcttccgattcgtcgtcggcaagaaggatgaaaaagcctatatgccgtcccgattggtcatgaatactgaaataatgcataaattccccacccgccttttttcagacggcatcaac

SEQ ID NO: 5772 - protein, 57 aa, Neisseria gonorrhoeae
MVARPIFQFNGKTPALQPCFRFVVGKKDEKAYMPSRLVMNTEIMHKFPTRLFSDGIN

SEQ ID NO: 5773 - DNA, 129 bp, Neisseria gonorrhoeae
gtgaaaatggcggaagtcgggtattttgacggaaaaaagggggatatgcggtttgccggtgttttcggctgggggagggagaatttctttgcatttttcccgtccaaactggtacattcgccctgtttt

SEQ ID NO: 5774 - protein, 43 aa, Neisseria gonorrhoeae
VKMAEVGYFDGKKGDMRFAGVFGWGRENFFAFFPSKLVHSPCF

SEQ ID NO: 5775 - DNA, 159 bp, Neisseria gonorrhoeae
atgtaccagtttggacgggaaaaatgcaaagaaattctccctcccccagccgaaaacaccggcaaaccgcatatcccccttttttccgtcaaaatacccgacttccgccattttcacgcaaacgcccgattaagccaagcaattgcaaagattttttgc

SEQ ID NO: 5776 - protein, 53 aa, Neisseria gonorrhoeae
MYQFGREKCKEILPPPAENTGKPHIPLFSVKIPDFRHFHANARLSQAIAKIFC

SEQ ID NO: 5777 - DNA, 93 bp, Neisseria gonorrhoeae
ttgataaaagaagcaggctattctagcaaaaaatctttgcaattgcttggcttaatcgggcgtttgcgtgaaaatggcggaagtcgggtattt

SEQ ID NO: 5778 - protein, 31 aa, Neisseria gonorrhoeae
LIKEAGYSSKKSLQLLGLIGRLRENGGSRVF

SEQ ID NO: 5779 - DNA, 171 bp, Neisseria gonorrhoeae
ttgcaaagattttttgctagaatagcctgcttcttttatcaaccgtttcagacggctccactactttcccgtcaaggaaagcaaaacggattcggcacgaatccgattagtatccgtgtccgattccaatgccgtctgaaactttccggagtaagaaaatgtcccaaaaat

SEQ ID NO: 5780 - protein, 57 aa, Neisseria gonorrhoeae
LQRFFARIACFFYQPFQTAPLLSRQGKQNGFGTNPISIRVRFQCRLKLSGVRKCPKN

SEQ ID NO: 5781 - DNA, 1194 bp, Neisseria gonorrhoeae
atgtcccaaaaattgatcttggttttgaactgcggcagctcgtccctcaaaggcgcggtcctggataacggcagcggcgaagtcctgctgagctgccttgccgaaaaactcaacctgcccgatgcctacattacattcaaagtaaacggcgaaaaacacaaagtcgatctgtccgcacaccccgaccacaccggcgcggtcgaagccctgatggaagaactcgaagcccacggcctcgacagccgcatcggcgccatcggccaccgcgtcgtcagcggcggcgaactgtacaacgaatccatcctcgttgacgacgaagtcatcgccggcatcgaaaaatgcatcccgctggctcctctgcacaatcccgcccacctcttgggcctgcgtgccgcgcaaagcattttcaaaggcctgcccaacgtcgtcgtattcgatacctccttccaccaaaccatgcccgaagtcgcctacaaatacgccgttccgcaggagttgtatgaaaaatacggcctgcgccgctacggcgcgcacggtaccagctaccgcttcgttgccgacgaaaccgcgcacttcctcggcaaagacaaaaaagacctgcgtatggtcattgcccacttgggcaacggcgcatccatcaccgccgtcgccaacggagaatcgcgcgacaccagtatgggcctgaccccgctggaagggctggtaatgggtacgcgcagcggcgacatcgatccttccgtattcggcttcctcgccgaaaacgccaatatgaccattgcccaaatcaccgacatgctgaacaaaaaatccggcctgctcggcatttccggcctgtccaacgactgccgcaccattgaagaagaagccgccaaggggcataaaggcgcgaaattggccttggatatgtttatctaccgccttgccaaatacatcggcagtatggcggttgccgcaggcggcttggacgcactggtctttaccggcggtatcggcgaaaactccgacatcatccgcgaacgcgtaatcggctacttgggcttcctcggtctgaacatcgaccaagaagccaacctgaaagcccgcttcggcaacgccggcgtgattaccactgccgacagcaaagccgttgccgtggtcattccgaccaacgaagagctgatgattgcccacgataccgcccgtttgagcggtctg

SEQ ID NO: 5782 - protein, 398 aa, Neisseria gonorrhoeae
MSQKLILVLNCGSSSLKGAVLDNGSGEVLLSCLAEKLNLPDAYITFKVNGEKHKVDLSAHPDHTGAVEALMEELEAHGLDSRIGAIGHRVVSGGELYNESILVDDEVIAGIEKCIPLAPLHNPAHLLGLRAAQSIFKGLPNVVVFDTSFHQTMPEVAYKYAVPQELYEKYGLRRYGAHGTSYRFVADETAHFLGKDKKDLRMVIAHLGNGASITAVANGESRDTSMGLTPLEGLVMGTRSGDIDPSVFGFLAENANMTIAQITDMLNKKSGLLGISGLSNDCRTIEEEAAKGHKGAKLALDMFIYRLAKYIGSMAVAAGGLDALVFTGGIGENSDIIRERVIGYLGFLGLNIDQEANLKARFGNAGVITTADSKAVAVVIPTNEELMIAHDTARLSGL

SEQ ID NO: 5783 - DNA, 402 bp, Neisseria gonorrhoeae; identical to SEQ ID NO: 149

SEQ ID NO: 5784 - protein, 134 aa, Neisseria gonorrhoeae; identical to SEQ ID NO: 150

SEQ ID NO: 5785 - DNA, 1368 bp, Neisseria gonorrhoeae
atgttagacaatttaaccggccgcttcagcaatgtcttcaaaaacatccgggggcaggccaaactgaccgaagacaatattaaagaagccttgcgcgaagtccgactcgccctgcttgaggcggatgtcgccctgcctgtcgtcaaagagttcgtcaacaacgtcaaagaaaaggccctcggtcaggaagtggcgggcagcctgacgcctgaccaagcctttatcggcgtggtcaaccaagccttagtcgaactgatgggcaaggaaaacaaaacactggatttatcggtttcaccgcctgccatcattttgatggccggtttgcagggtgccggtaagacaacaaccgtcggcaaactcgcccgcctgctgaaaaacgatcagaagaaaaaagttttggtggtatccgccgacgtttaccgccctgccgcgattgaacagctgcgcctgttggccgaacaggtcggcgtagattttttcccatccgataccaaccaaaaaccggttgagattgcaactgccgccgttgattacgccaaaaaacatttttacgatgtattgatggtcgataccgccggccgtttggcaatcgatgaagagatgatgaacgaaatcaaagcgcttcatgcggtggtcaacccggttgaaactttgttcgttatcgatgccatgctgggtcaggatgcggtaaataccgctcaggcatttaatgaagccctgccgctgaacggcgtcgtattgaccaagatggacggcgactcgcgcggcggtgcggcattgtccgtacgccatgtaaccggcaaaccgattaaatttatcggcgtcggcgagaaaatcaacggcctcgaacctttccaccccgaccgtcttgccagccgtatcctcggcatgggcgacgtattgaccctgattgaagacgttcaaaaaggtattgatgaagaagccgccgccaaaatggcgaaaaagctgcaaaaaggcaaaggctttgacctcaatgattttaaagaacaaatccagcaaatgcgcaatatgggcggtttggaaaacctgatgtcgaaaatgccgggcgaactgggtcaaatatcgaaacaaatccccgaaggtacggctgaaaaagcgatgggcaaagtagaagccatcatcaactcgatgacccctaaagaacgcgccaaccctgccctgctcaaagccggccgcaaacgccgtattgcgatgggcgcgggcacgaccgtgcaggaagtgaacaaattgctcaaacagtttgaacaaatgcagcagatgatgaagatgttcagcggcaacggtttgggcaaactgatgcgcttggccaaaggcatgaagggaataaagggaatgtttcccggtctt

SEQ ID NO: 5786 - protein, 456 aa, Neisseria gonorrhoeae
MLDNLTGRFSNVFKNIRGQAKLTEDNIKEALREVRLALLEADVALPVVKEFVNNVKEKALGQEVAGSLTPDQAFIGVVNQALVELMGKENKTLDLSVSPPAIILMAGLQGAGKTTTVGKLARLLKNDQKKKVLVVSADVYRPAAIEQLRLLAEQVGVDFFPSDTNQKPVEIATAAVDYAKKHFYDVLMVDTAGRLAIDEEMMNEIKALHAVVNPVETLFVIDAMLGQDAVNTAQAFNEALPLNGVVLTKMDGDSRGGAALSVRHVTGKPIKFIGVGEKINGLEPFHPDRLASRILGMGDVLTLIEDVQKGIDEEAAAKMAKKLQKGKGFDLNDFKEQIQQMRNMGGLENLMSKMPGELGQISKQIPEGTAEKAMGKVEAIINSMTPKERANPALLKAGRKRRIAMGAGTTVQEVNKLLKQFEQMQQMMKMFSGNGLGKLMRLAKGMKGIKGMFPGL

SEQ ID NO: 5787 - DNA, 1254 bp, Neisseria gonorrhoeae
gtgggcaatcatcagctcttcgttggtcggaatgaccacggcaacggctttgctgtcggcagtggtaatcacgccggcgttgccgaagcgggctttcaggttggcttcttggtcgatgttcagaccgaggaagcccaagtagccgattacgcgttcgcggatgatgtcggagttttcgccgataccgccggtaaagaccagtgcgtccaagccgcctgcggcaaccgccatactgccgatgtatttggcaaggcggtagataaacatatccaaggccaatttcgcgcctttatgccccttggcggcttcttcttcaatggtgcggcagtcgttggacaggccggaaatgccgagcaggccggattttttgttcagcatgtcggtgatttgggcaatggtcatattggcgttttcggcgaggaagccgaatacggaaggatcgatgtcgccgctgcgcgtacccattaccagcccttccagcggggtcaggcccatactggtgtcgcgcgattctccgttggcgacggcggtgatggatgcgccgttgcccaagtgggcaatgaccatacgcaggtcttttttgtctttgccgaggaagtgcgcggtttcgtcggcaacgaagcggtagctggtaccgtgcgcgccgtagcggcgcaggccgtatttttcatacaactcctgcggaacggcgtatttgtaggcgacttcgggcatggtttggtggaaggaggtatcgaatacgacgacgttgggcaggcctttgaaaatgctttgcgcggcacgcaggcccaagaggtgggcgggattgtgcagaggagccagcgggatgcatttttcgatgccggcgatgacttcgtcgtcaacgaggatggattcgttgtacagttcgccgccgctgacgacgcggtggccgatggcgccgatgcggctgtcgaggccgtgggcttcgagttcttccatcagggcttcgaccgcgccggtgtggtcggggtgtgcggacagatcgactttgtgtttttcgccgtttactttgaatgtaatgtaggcatcgggcaggttgagtttttcggcaaggcagctcagcaggacttcgccgctgccgttatccaggaccgcgcctttgagggacgagctgccgcagttcaaaaccaagatcaatttttgggacattttcttactccggaaagtttcagacggcattggaatcggacacggatactaatcggattcgtgccgaatccgttttgctttcct

SEQ ID NO: 5788 - protein, 418 aa, Neisseria gonorrhoeae
VGNHQLFVGRNDHGNGFAVGSGNHAGVAEAGFQVGFLVDVQTEEAQVADYAFADDVGVFADTAGKDQCVQAACGNRHTADVFGKAVDKHIQGQFRAFMPLGGFFFNGAAVVGQAGNAEQAGFFVQHVGDLGNGHIGVFGEEAEYGRIDVAAARTHYQPFQRGQAHTGVARFSVGDGGDGCAVAQVGNDHTQVFFVFAEEVRGFVGNEAVAGTVRAVAAQAVFFIQLLRNGVFVGDFGHGLVEGGIEYDDVGQAFENALRGTQAQEVGGIVQRSQRDAFFDAGDDFVVNEDGFVVQFAAADDAVADGADAAVEAVGFEFFHQGFDRAGVVGVCGQIDFVFFAVYFECNVGIGQVEFFGKAAQQDFAAAVIQDRAFEGRAAAVQNQDQFLGHFLTPESFRRHWNRTRILIGFVPNPFCFP

SEQ ID NO: 5789 - DNA, 198 bp, Neisseria gonorrhoeae
atgtttttccacaaaagatacacacaccggcaaacaccggctgtgtttatcttttcttatgcctattttttaatcatcgtatttttatcttttaatttcaatacgcaaaccgacttatacacacggttttcacatctttggactgcttccgtgtgtatagcggatattgccgttttcctatctgacaaaaatgccgtc

SEQ ID NO: 5790 - protein, 66 aa, Neisseria gonorrhoeae
MFFHKRYTHRQTPAVFIFSYAYFLIIVFLSFNFNTQTDLYTRFSHLWTASVCIADIAVFLSDKNAV

SEQ ID NO: 5791 - DNA, 123 bp, Neisseria gonorrhoeae
ttgtcagataggaaaacggcaatatccgctatacacacggaagcagtccaaagatgtgaaaaccgtgtgtataagtcggtttgcgtattgaaattaaaagataaaaatacgatgattaaaaaa

SEQ ID NO: 5792 - protein, 41 aa, Neisseria gonorrhoeae
LSDRKTAISAIHTEAVQRCENRVYKSVCVLKLKDKNTMIKK

SEQ ID NO: 5793 - DNA, 906 bp, Neisseria gonorrhoeae
ttgttcataccactcgataaacttgtctgctttgacaaaacccagcagcggctcgctgcggctgccgtcggcgcggacgacaaacacgcccggcggcccgaacagaccgtattctttcaacaacgcctgatgttcgggcgtgttggcggttacgtcgatctggaaaaagcgttccatatcgactgcctgatgcacttccggctgattgagcgtgtaaaccgccatttctttgcaggaaatgcaccagtcggcataaaaatccaaaacgacaggtttgtcgggatgttctttcaacgccgtatccatcgctgccttcagcgcggcagtatcggcaaacattttgccgtgttccgaaaatttgcctgcttcggccggcggattgagggtcaagaaatggtgcagcgcggtcgttttgccgtttgcgccctgccagccgaaccacgcgccgcctatcagcaatatgctgcccaatgcgaatgccacagctttcggacggcgtttctgcctgcgtccgttgaccagcagcataaaggcaggaaccagcatcagcagcgtgtacagcgcgacgacgagataatagggcaaatgcggcgtggcgaggtaaacggcgacggcaagcaggataaagccgaaagcgtatttgacggcattcatccaatcgcccgccttaggcaggatatgtcctccgaacgtgccgatggcaatcagcggcacgccggtgcccaacgccaaagtgtaaagtgccaaaccgcccaaaaccgcatcgcccgtctgaccgatatagcccaaggcaaacgccagcggcggggcgacgcacggtccgacaatcagtgcggacagaatacccataataaagacggaaacgattttaccgccggagagcctgctgctctggttttggaaata

SEQ ID NO: 5794 - protein, 302 aa, Neisseria gonorrhoeae
LFIPLDKLVCFDKTQQRLAAAAVGADDKHARRPEQTVFFQQRLMFGRVGGYVDLEKAFHIDCLMHFRLIERVNRHFFAGNAPVGIKIQNDRFVGMFFQRRIHRCLQRGSIGKHFAVFRKFACFGRRIEGQEMVQRGRFAVCALPAEPRAAYQQYAAQCECHSFRTAFLPASVDQQHKGRNQHQQRVQRDDEIIGQMRRGEVNGDGKQDKAESVFDGIHPIARLRQDMSSERADGNQRHAGAQRQSVKCQTAQNRIARLTDIAQGKRQRRGDARSDNQCGQNTHNKDGNDFTAGEPAALVLEI

SEQ ID NO: 5795 - DNA, 1839 bp, Neisseria gonorrhoeae
atgcggacaaattatttgtctgaaacggattcgattatgaaaaaactgatttgcctgttcgccgtatttttgatgttgtgcggacgggctttcgcgctggatgcgaacgatctgctgccgccggaaaaggcattcgtgccggagcttactgttgccgacgacggcgtgaacgtccgtttcaggattgccgacggatactatatgtatcaggcgaaaatcgtcggcaagaccgatccggcggatttgttgggacagccttctttcagtaagggcgaagagaaggaagacgagtttttcggcaggcagacggttcaccatcacgaggcgcaggttgcctttccttatgcaaaggctgtcggcgaaccgtataaattggttttgacctatcagggctgtgccgaagccggcgtgtgctatccgcccgtggataccgagtttgatatttccggcaacggcacttaccatccgcaaaccgacgaaccggcatccgccaaagaccgttttttgcagccttcctctcaaaacggcagcggggcgttgccacccccgaagggggacgagggcggcgacggccgtttcaagctgtcttgggatacgctcaacgccaatcttttggcgttttttctcgccggtttgggcctgagttttaccgcttgtatgtatcccctgctgccgattgtgtccagtatcgtggtcggtgacaaaaaggcgggcaaggcgcgggcgtttgtgctgtccgtcgtttatgttcagggtttggctctgacttatacgctggtcggcattgttgccggactgacgggcgcgctgctgaccgtatggttgcagcaggcttgggtcgtgttggcggcatcggctttgatggtcgtcttggcgctgtctatgttcgggctgttcaacatccagcttcccaacgccgtacagtcatatttccaaaaccagagcagcaggctctccggcggtaaaatcgtttccgtctttattatgggtattctgtccgcactgattgtcggaccgtgcgtcgccccgccgctggcgtttgccttgggctatatcggtcagacgggcgatgcggttttgggcggtttggcactttacactttggcgttgggcaccggcgtgccgctgattgccatcggcacgttcggaggacatatcctgcctaaggcgggcgattggatgaatgccgtcaaatacgctttcggctttatcctgcttgccgtcgccgtttacctcgccacgccgcatttgccctattatctcgtcgtcgcgctgtacacgctgctgatgctggttcctgcctttatgctgctggtcaacggacgcaggcagaaacgccgtccgaaagctgtggcattcgcattgggcagcatattgctgataggcggcgcgtggttcggctggcagggcgcaaacggcaaaacgaccgcgctgcaccatttcttgaccctcaatccgccggccgaagcaggcaaattttcggaacacggcaaaatgtttgccgatactgccgcgctgaaggcagcgatggatacggcgttgaaagaacatcccgacaaacctgtcgttttggatttttatgccgactggtgcatttcctgcaaagaaatggcggtttacacgctcaatcagccggaagtgcatcaggcagtcgatatggaacgctttttccagatcgacgtaaccgccaacacgcccgaacatcaggcgttgttgaaagaatacggtctgttcgggccgccgggcgtgtttgtcgtccgcgccgacggcagccgcagcgagccgctgctgggttttgtcaaagcagacaagtttatcgagtggtatgaacaaaaccgc

SEQ ID NO: 5796 - protein, 613 aa, Neisseria gonorrhoeae
MRTNYLSETDSIMKKLICLFAVFLMLCGRAFALDANDLLPPEKAFVPELTVADDGVNVRFRIADGYYMYQAKIVGKTDPADLLGQPSFSKGEEKEDEFFGRQTVHHHEAQVAFPYAKAVGEPYKLVLTYQGCAEAGVCYPPVDTEFDISGNGTYHPQTDEPASAKDRFLQPSSQNGSGALPPPKGDEGGDGRFKLSWDTLNANLLAFFLAGLGLSFTACMYPLLPIVSSIVVGDKKAGKARAFVLSVVYVQGLALTYTLVGIVAGLTGALLTVWLQQAWVVLAASALMVVLALSMFGLFNIQLPNAVQSYFQNQSSRLSGGKIVSVFIMGILSALIVGPCVAPPLAFALGYIGQTGDAVLGGLALYTLALGTGVPLIAIGTFGGHILPKAGDWMNAVKYAFGFILLAVAVYLATPHLPYYLVVALYTLLMLVPAFMLLVNGRRQKRRPKAVAFALGSILLIGGAWFGWQGANGKTTALHHFLTLNPPAEAGKFSEHGKMFADTAALKAAMDTALKEHPDKPVVLDFYADWCISCKEMAVYTLNQPEVHQAVDMERFFQIDVTANTPEHQALLKEYGLFGPPGVFVVRADGSRSEPLLGFVKADKFIEWYEQNR

SEQ ID NO: 5797 - DNA, 468 bp, Neisseria gonorrhoeae
atgtacgatgtcaatacccacgatgtccgccgctttttcgcccgcgtgtggcagcagcggctcaatccgctgcaattgggcgcgttggaacagaaagccctccgcattgtcgaagcccatcccgaataccaccgttatctcgaacgcatcgaagaccatctggacaccgactggctgcccgaaaacggcgaaagcaaccccttcctgcatatgtcgctgcatttgtccgtccaagaacaggcgggcatagaccagccgcacggcatacgcgccatccacgacaccctgtgcgccaaacgcggctggccggaagccgaacacgaaatgatggaggcactggcggaaacactgtggacggcgcaacgctacggcaccggtttggatgtcaatttctacatgacccgactgcgcaaactcatcggcttgggtgcagaggatcaagccaggttaaacccgcatgaaatcgcc

SEQ ID NO: 5798 - protein, 156 aa, Neisseria gonorrhoeae
MYDVNTHDVRRFFARVWQQRLNPLQLGALEQKALRIVEAHPEYHRYLERIEDHLDTDWLPENGESNPFLHMSLHLSVQEQAGIDQPHGIRAIHDTLCAKRGWPEAEHEMMEALAETLWTAQRYGTGLDVNFYMTRLRKLIGLGAEDQARLNPHEIA

SEQ ID NO: 5799 - DNA, 408 bp, Neisseria gonorrhoeae; identical to SEQ ID NO: 151

SEQ ID NO: 5800 - protein, 136 aa, Neisseria gonorrhoeae; identical to SEQ ID NO: 152

SEQ ID NO: 5801 - DNA, 93 bp, Neisseria gonorrhoeae
ttgcttgattttgcaggtgtgaaattgtcgcacgagcaggcatgttttagctattcggaaattcgaggaagggtgcatcaacctgttttgaaa

SEQ ID NO: 5802 - protein, 31 aa, Neisseria gonorrhoeae
LLDFAGVKLSHEQACFSYSEIRGRVHQPVLK

SEQ ID NO: 5803 - DNA, 93 bp, Neisseria gonorrhoeae
ttgggggaaaatgaatgccgtctgaaaggggttgttccgcttcagacggcattttgcaggcggtcggtatggtcaggcgatttcatgcgggtt

SEQ ID NO: 5804 - protein, 31 aa, Neisseria gonorrhoeae
LGENECRLKGVVPLQTAFCRRSVWSGDFMRV

SEQ ID NO: 5805 - DNA, 810 bp, Neisseria gonorrhoeae
atgtcggttgggcattatgagaattttcccgtcggttcgctgattttgccgcgcaggttgaggaagccggttcatgcggtgtatgcgtttgcacggacggcggacgatatggcggacgagggcagtatgccgtctgaagccaggttgtcggggttggagggtttgcggcgcgagttggacgtgttggcatcgggcggccggtcggcgcatcctttgattgcacgattggatgccgaggcggttgtgccgttcggtttggatttgcagccgttttatgatctgctctcggcgttttcgcaggatgtggttaaaacgcggtacgcgcatttcggcgatctgaccgattattgccggcgttccgccaaccctgtcggacgcattatgctggctttatacgggaaaacggatgcggtgtgcgtagcgcaaagcgacggtatttgtacggctttgcaactggtgaatttttggcaggatgtagctgtggattggcaaaagggcagggtttatatcccgcaggacgatttgttgaaattcggtgtttctgaggaacagatcgcagcaggacgggcggatgcggcgtttcagcggctgatggcgtatgagtgccggcgtgcattccgtatgctgaaggcgggttcgcctttggcgcgcgaattgaaagggcgtatcggtttggaactccgtatgattgtgttgggggcgcagttgattttgcagaaactggacgcgtgccgatacgatgtgtttgcacaacgccccgttttggataagaaggattggttgattatgttgaaacgcgcgttgtggaaa

SEQ ID NO: 5806 - protein, 270 aa, Neisseria gonorrhoeae
MSVGHYENFPVGSLILPRRLRKPVHAVYAFARTADDMADEGSMPSEARLSGLEGLRRELDVLASGGRSAHPLIARLDAEAVVPFGLDLQPFYDLLSAFSQDVVKTRYAHFGDLTDYCRRSANPVGRIMLALYGKTDAVCVAQSDGICTALQLVNFWQDVAVDWQKGRVYIPQDDLLKFGVSEEQIAAGRADAAFQRLMAYECRRAFRMLKAGSPLARELKGRIGLELRMIVLGAQLILQKLDACRYDVFAQRPVLDKKDWLIMLKRALWK

SEQ ID NO: 5807 - DNA, 111 bp, Neisseria gonorrhoeae
atgcccaaccgacataccttctccatccatcaaacaaaatgccgtctgaaacggaacaaacccttttcagacggcatcagatacctccaagctgccggcaatcagtggtgg

SEQ ID NO: 5808 - protein, 37 aa, Neisseria gonorrhoeae
MPNRHTFSIHQTKCRLKRNKPFSDGIRYLQAAGNQWW

SEQ ID NO: 5809 - DNA, 588 bp, Neisseria gonorrhoeae
atgccgtctgaaacggaacaaacccttttcagacggcatcagatacctccaagctgccggcaatcagtggtggtaatgaccgtgcgaaccgtggacatgaccgtgtgcgatttcctcatcggatgcatcgcgcacgctttcaaccgtagctttaaagcggattttcatgcctgccaaaggatggttgccgtccaccaccgccttgccgtcggcaacatcggttacacgatagacgacaacatcgccggtttcaggatcgtcggcttcaaacatcatgccgacttcgacttcaacagggaacgcgcccgcatcttcaatacggaccaactccgaatcctgctcgccgaacgcatcgtcggacgaaagcgccacatcgaccgtatcgccggcatccttaccgtgcaacgcctcttccaccaaagggaaaatgccgtcgtaaccgccgtgcagatacgcaatcggttcttcggttttatccaaaagctgattgttggcatcatacatctcataatgcagcgaaaccacggaattttttgcaatagccatatttgtcctttcaggaacagcagattgattacaggcgcattc

SEQ ID NO: 5810 - protein, 196 aa, Neisseria gonorrhoeae
MPSETEQTLFRRHQIPPSCRQSVVVMTVRTVDMTVCDFLIGCIAHAFNRSFKADFHACQRMVAVHHRLAVGNIGYTIDDNIAGFRIVGFKHHADFDFNRERARIFNTDQLRILLAERIVGRKRHIDRIAGILTVQRLFHQRENAVVTAVQIRNRFFGFIQKLIVGIIHLIMQRNHGIFCNSHICPFRNSRLITGAF

SEQ ID NO: 5811 - DNA, 528 bp, Neisseria gonorrhoeae
gtgttagaatgcgcctgtaatcaatctgctgttcctgaaaggacaaatatggctattgcaaaaaattccgtggtttcgctgcattatgagatgtatgatgccaacaatcagcttttggataaaaccgaagaaccgattgcgtatctgcacggcggttacgacggcattttccctttggtggaagaggcgttgcacggtaaggatgccggcgatacggtcgatgtggcgctttcgtccgacgatgcgttcggcgagcaggattcggagttggtccgtattgaagatgcgggcgcgttccctgttgaagtcgaagtcggcatgatgtttgaagccgacgatcctgaaaccggcgatgttgtcgtctatcgtgtaaccgatgttgccgacggcaaggcggtggtggacggcaaccatcctttggcaggcatgaaaatccgctttaaagctacggttgaaagcgtgcgcgatgcatccgatgaggaaatcgcacacggtcatgtccacggttcgcacggtcattaccaccac

SEQ ID NO: 5812 - protein, 176 aa, Neisseria gonorrhoeae
VLECACNQSAVPERTNMAIAKNSVVSLHYEMYDANNQLLDKTEEPIAYLHGGYDGIFPLVEEALHGKDAGDTVDVALSSDDAFGEQDSELVRIEDAGAFPVEVEVGMMFEADDPETGDVVVYRVTDVADGKAVVDGNHPLAGMKIRFKATVESVRDASDEEIAHGHVHGSHGHYHH

SEQ ID NO: 5813 - DNA, 135 bp, Neisseria gonorrhoeae
atggtttttgagagtgttgtaaaaaatttacactgcaataaaataacaaaaatttacattgaaatatgtgccgtacagtttatgaacaggttaacggtaatcggccggcgcggcggttgtgttagaatgcgcctg

SEQ ID NO: 5814 - protein, 45 aa, Neisseria gonorrhoeae
MVFESVVKNLHCNKITKIYIEICAVQFMNRLTVIGRRGGCVRMRL

SEQ ID NO: 5815 - DNA, 282 bp, Neisseria gonorrhoeae
ttgcagtgtaaattttttacaacactctcaaaaaccattccgacccatctgccgacttccccaatctgccttaataaatcatacaagatactgaattatattaatctctataatatttatccctatcggatttttaacagcaaaaccgttttacaggatttatcaatccgcccgccagaaaacttttcattcaaacctttttcccatctgtacgacattgcaatcccttattccatggtgcataattacgcaaattcagcgatgaatttccaacccggtttg

SEQ ID NO: 5816 - protein, 94 aa, Neisseria gonorrhoeae
LQCKFFTTLSKTIPTHLPTSPICLNKSYKILNYINLYNIYPYRIFNSKTVLQDLSIRPPENFSFKPFSHLYDIAIPYSMVHNYANSAMNFQPGL

SEQ ID NO: 5817 - DNA, 237 bp, Neisseria gonorrhoeae
ttgttgtctttggctttggctgcctgcggcggagaaaaagccgctgaagctcctgctgctgaggcttcctctaccgaggcacctgctgccgaagctcccgctgccgaagcacctgccgccgaagctgctgctgctgaagcacctgccgccgaagctcccgctgctgaagctcctgccgccgaagctgctgctaccgaagcacctgccgctgaagctcctgctgccgaagctgcaaaa

SEQ ID NO: 5818 - protein, 79 aa, Neisseria gonorrhoeae
LLSLALAACGGEKAAEAPAAEASSTEAPAAEAPAAEAPAAEAAAAEAPAAEAPAAEAPAAEAAATEAPAAEAPAAEAAK

SEQ ID NO: 5819 - DNA, 315 bp, Neisseria gonorrhoeae
ttgcaagcggaaaatgcttattttgcagcttcggcagcaggagcttcagcggcaggtgcttcggtagcagcagcttcggcggcaggagcttcagcagcgggagcttcggcggcaggtgcttcagcagcagcagcttcggcggcaggtgcttcggcagcgggagcttcggcagcaggtgcctcggtagaggaagcctcagcagcaggagcttcagcggctttttctccgccgcaggcagccaaagccaaagacaacaaagcagcggcaaacagggattttttcattttagtaacctttaaaatcaatttaaattat

SEQ ID NO: 5820 - protein, 105 aa, Neisseria gonorrhoeae
LQAENAYFAASAAGASAAGASVAAASAAGASAAGASAAGASAAAASAAGASAAGASAAGASVEEASAAGASAAFSPPQAAKAKDNKAAANRDFFILVTFKINLNY

SEQ ID NO: 5821 - DNA, 1023 bp, Neisseria gonorrhoeae; identical to SEQ ID NO: 153

SEQ ID NO: 5822 - protein, 341 aa, Neisseria gonorrhoeae; identical to SEQ ID NO: 154

SEQ ID NO: 5823 - DNA, 1050 bp, Neisseria gonorrhoeae
gtgcggcagtacttgccatactcggtgcgttggtgttttttcatcaaccccggcgctatcatcctgcaccgccaaattttcttggaacttatgctgccggctgcatacggcggttttttgactaccgctttgttggaccggacgggtttttcaggcaacctgaaacctgccgctactttgatggcggtgttgttgcttgttgcggctgttttattgccgtttttaccgcaacttgccgcatttttcgtcgccgcctattggctggtgttgctgctgttctgcgcctggctgatttggctcgaccgcaacaccgacaacttcgctctgttgatgttacttgccgcatttaccgtttttcagacggcctatgccgtcagcggcgatttgaacttactgcgcgcgcaagtgcatttgaatatggcggcggtcatgttcgtatccgtccgcgtcagcgtccttttgggcacggaaaccctgaaagaatgccgtctgaaagaccccgtattcatccccaacgttatctataaaaacatcgccatcaccctgctgctgcacgccgccgccgaactttggctgcccgcgcaaaccgccggttttactgcgcttgccgtcggcttcatcctgctcgccaagctgcgcgaactgcaccatcacgaactcttacgcaaacactacgtccgcacttattacctgctccagctctttgccgccgcaggttatctgtggacaggcgcggcgaaactgcaaaacctgcccgcctccgcgcccctgcacctgattaccctcggcggcatgacgggtggcgtgatgatggtgtggctgactgccggactgtggcacagcggctttaccaaactcgactacccgaaactctgccgcatcgccgtctccatccttttcgcctccgccgtttcgcgcgctgttttaatgaacgtgaatccgatattcttcatcaccgttcccgagattctgaccgccgccgtgttcatgctttacctgctgacgttcgtaccgatttttcgagcgaacgcgtttacagacgatccggaa

SEQ ID NO: 5824 - protein, 350 aa, Neisseria gonorrhoeae
VRQYLPYSVRWCFFINPGAIILHRQIFLELMLPAAYGGFLTTALLDRTGFSGNLKPAATLMAVLLLVAAVLLPFLPQLAAFFVAAYWLVLLLFCAWLIWLDRNTDNFALLMLLAAFTVFQTAYAVSGDLNLLRAQVHLNMAAVMFVSVRVSVLLGTETLKECRLKDPVFIPNVIYKNIAITLLLHAAAELWLPAQTAGFTALAVGFILLAKLRELHHHELLRKHYVRTYYLLQLFAAAGYLWTGAAKLQNLPASAPLHLITLGGMTGGVMMVWLTAGLWHSGFTKLDYPKLCRIAVSILFASAVSRAVLMNVNPIFFITVPEILTAAVFMLYLLTFVPIFRANAFTDDPE

SEQ ID NO: 5825 - DNA, 300 bp, Neisseria gonorrhoeae
ttgccgctgctttgttgtctttggctttggctgcctgcggcggagaaaaagccgctgaagctcctgctgctgaggcttcctctaccgaggcacctgctgccgaagctcccgctgccgaagcacctgccgccgaagctgctgctgctgaagcacctgccgccgaagctcccgctgctgaagctcctgccgccgaagctgctgctaccgaagcacctgccgctgaagctcctgctgccgaagctgcaaaataagcattttccgcttgcaaaaaagcaggatacgttcagtatcctgcttttt

SEQ ID NO: 5826 - protein, 100 aa, Neisseria gonorrhoeae
LPLLCCLWLWLPAAEKKPLKLLLLRLPLPRHLLPKLPLPKHLPPKLLLLKHLPPKLPLLKLLPPKLLLPKHLPLKLLLPKLQNKHFPLAKKQDTFSILLF

SEQ ID NO: 5827 - DNA, 1365 bp, Neisseria gonorrhoeae
atgcctgaccttcataccgaattttcccgactcctgccggcagatgaaattgccgaaccttctccgacgcttttaaaagatcagcgcaaccgctttacgtctgcaccagacatcattttgcagccgcgcagcgttgaaagcgtgcaaaccattatgcgtttttgttacgaacaccgcattccggttacgccgcaaggcggcaataccggtttgtgcggcgcggcagtatcggaaaacggcgtattgctgaacctttccaaactcaaccgcatccgcagcatcaatttgtcagacaactgcataaccgtcgaagcaggttccgtactccaaaccgtccaacaggcagccgaagcctcaaacaggctgttcccactcagtctcgccagcgaaggctcgtgccaaatcggcggcaacatcgcctgcaatgccggaggtttgaacgtattgcgttacggcacgatgcgcgacctggttatcggtttggaagtcgtcctccccaacggcgaactggtttcccatctccatcccctgcataaaaacaccaccggctacgacctgcgccatctgtttatcggcagcgaaggcacactgggcatcatcactgccgccacgctcaagctttttgcccgtccctcggacaaggcaacggcatgggtcggcattcccgacatcgaatccgccgtccgcctgctgaccgaaacccaagcgcactttgccgaacgcttatgcagttttgaactgatcggccgttttgccgccaagttgtcttccgaattcagcaaactccccctgccgacacattcagaatggcatattttacttgagttgaccgactcattacccgacagcaatcttgatgatcggcttgtcgaatttctttataaaaaaggatttaccgacagcgtattggcgcaaagcgaacaagaacgtatccatatgtgggcgttgcgcgaaaacatctccgcctcccaacgcaaactgggcaccagcatcaaacacgatattgccgttcctatcgggcgcgttgccgactttgtccgccagtgcgccaaagatttggaacagaatttcaaaggcatacaaatcgtctgcttcggacatctgggcgacggcagcctgcactacaatacttttccgcccgaaatcctcagcaatgaagtttaccgttacgaaaacgacatcaacagcacagtctatcgcaacgtccttgcccgcaacggcacgattgccgccgaacacggcataggtatcatcaaaaaacaatggctgcccgctgtccgcacgccctctgaaattgccctgatgaaaagcatcaaacaacaccttgatccatataacattatgaatcctggcaaactgcttccg

SEQ ID NO: 5828 - protein, 455 aa, Neisseria gonorrhoeae
MPDLHTEFSRLLPADEIAEPSPTLLKDQRNRFTSAPDIILQPRSVESVQTIMRFCYEHRIPVTPQGGNTGLCGAAVSENGVLLNLSKLNRIRSINLSDNCITVEAGSVLQTVQQAAEASNRLFPLSLASEGSCQIGGNIACNAGGLNVLRYGTMRDLVIGLEVVLPNGELVSHLHPLHKNTTGYDLRHLFIGSEGTLGIITAATLKLFARPSDKATAWVGIPDIESAVRLLTETQAHFAERLCSFELIGRFAAKLSSEFSKLPLPTHSEWHILLELTDSLPDSNLDDRLVEFLYKKGFTDSVLAQSEQERIHMWALRENISASQRKLGTSIKHDIAVPIGRVADFVRQCAKDLEQNFKGIQIVCFGHLGDGSLHYNTFPPEILSNEVYRYENDINSTVYRNVLARNGTIAAEHGIGIIKKQWLPAVRTPSEIALMKSIKQHLDPYNIMNPGKLLP

SEQ ID NO: 5829 - DNA, 240 bp, Neisseria gonorrhoeae
atggatttagattttttccatcgcactcgagcacgctatttagaattagtaaaagataatccaaaagcagtcgtaattaatgcagagcagactattgaacttgttcaagctgaaattgaaagtgcggtaaaaattggtggaaattacacgaaaaatgaccgcacttttaaaataataaaatcggcagtgaatttccctgccgattttattttgttacaatttaacttaaaacgtccactg

SEQ ID NO: 5830 - protein, 80 aa, Neisseria gonorrhoeae
MDLDFFHRTRARYLELVKDNPKAVVINAEQTIELVQAEIESAVKIGGNYTKNDRTFKIIKSAVNFPADFILLQFNLKRPL

SEQ ID NO: 5831 - DNA, 111 bp, Neisseria gonorrhoeae
atgacaaggaatacactgaagattaccttgttggcttcgcccgaggtttcggggttgaaaaaagaaatggggaagaagaaaaaccactccggcaatattttaaggactgtg

SEQ ID NO: 5832 - protein, 37 aa, Neisseria gonorrhoeae
MTRNTLKITLLASPEVSGLKKEMGKKKNHSGNILRTV

SEQ ID NO: 5833 - DNA, 1341 bp, Neisseria gonorrhoeae
ttgggagcattagaattaacaaattctctatggaaaccccgttggaactctaatattgattatttaataacaaaaaatgctgaaattcgtttcaacactaaaaatgaaagtttactcgtaaaagaagattatgctggcggagctcgttttcgttttgcttacgatctaaaagataaagtccctgaaataccagttttaacttttgaaaaaaatataactggcacatcagatattatttttgagggaaaagcgttggataatttgaaacacctagacgggcatcaaattgtcaaagtaaatgacaccgcagataaagatgcctttagactttccagtaaataccgaaagggaatttatacgctctctttacaacaacgcccagagggcttttttaccaaagtgcaagaacgcgatgatattgcgatttatgcacaacaggctcaagccgccaataccttattcgccttgcgtttgaacgacaaaaacagtgatattttcgaccgcactttaccacgcaaaggcttgtggttgcgtgtgattgacggacattccaaccaatgggtgcaaggcaaaacagcacctgtagaaggctatcgaaaaggtgtgcaactcggcggcgaggtgttcacatggcaaaacgaaagtaatcaactttctattggcttaatgggcggacaagcagaacaacgcagcactttccgcaatccggatacagacaatcttacaacgggaaatgtgaaaggctttggtgcgggcgtttacgccacttggcatcagcttcaggacaaacagacaggtgcgtatgttgatagctggatgcaatatcaacgtttccgccaccgcattaacactgaatatgctacagaacgttttacttcaaaaggtattactgcctcaattgaagcgggttacaatgcgttattggcggaacacttcactaaaaagggcaacagccttcgtgtttacctacaaccacaggcgcaattgacttatttgggggtaaacggaaaattcagcgatagcgaaaatgcccaagtgaatttgcttggctcccgccaattacaaagccgagtgggcgttcaagctaaagcgcaatttgctttcactaatggcgtcactttccaaccatttgttgctgtcaattcaatctaccaacaaaaacctttcggtgtggaaatagacggggatcgtcgagtgataaacaataagacggtaattgaaactcaattaggtgtagcagcgaaaatcaaatctcacttaaccttgcaagcctcattcaaccgccaaacaagcaaacatcatcacgctaaacaaggtgcgttgaatttacagtggacgttt

SEQ ID NO: 5834 - protein, 447 aa, Neisseria gonorrhoeae
LGALELTNSLWKPRWNSNIDYLITKNAEIRFNTKNESLLVKEDYAGGARFRFAYDLKDKVPEIPVLTFEKNITGTSDIIFEGKALDNLKHLDGHQIVKVNDTADKDAFRLSSKYRKGIYTLSLQQRPEGFFTKVQERDDIAIYAQQAQAANTLFALRLNDKNSDIFDRTLPRKGLWLRVIDGHSNQWVQGKTAPVEGYRKGVQLGGEVFTWQNESNQLSIGLMGGQAEQRSTFRNPDTDNLTTGNVKGFGAGVYATWHQLQDKQTGAYVDSWMQYQRFRHRINTEYATERFTSKGITASIEAGYNALLAEHFTKKGNSLRVYLQPQAQLTYLGVNGKFSDSENAQVNLLGSRQLQSRVGVQAKAQFAFTNGVTFQPFVAVNSIYQQKPFGVEIDGDRRVINNKTVIETQLGVAAKIKSHLTLQASFNRQTSKHHHAKQGALNLQWTF

SEQ ID NO: 5835 - DNA, 132 bp, Neisseria gonorrhoeae
atgcgggaatgtttggataagttcgcccgttactttttatgtgataagtttcttctttccaatattcactatttctatcgcggagttttttttaagcggataatttcatcatcagtgagcttggttttgtcg

SEQ ID NO: 5836 - protein, 44 aa, Neisseria gonorrhoeae
MRECLDKFARYFLCDKFLLSNIHYFYRGVFFKRIISSSVSLVLS

SEQ ID NO: 5837 - DNA, 132 bp, Neisseria gonorrhoeae
ttgttcagttttatgctaaaatccacgccctatttatttttacttgacaaaggaaaatttattatgaaactcgaagcaagcaagcagaagtttaaaaaatcatttattataagtctatttttttctattctt

SEQ ID NO: 5838 - protein, 44 aa, Neisseria gonorrhoeae
LFSFMLKSTPYLFLLDKGKFIMKLEASKQKFKKSFIISLFFSIL

SEQ ID NO: 5839 - DNA, 162 bp, Neisseria gonorrhoeae
gtggattttagcataaaactgaacaaaaaatgtcatttagttcaaattttctctatttatttcttatttattaaaagtaaacgtttgctttttgctattttgtcaagccggtttgaaaatgtgtataattgccctcgttatttacaaaaatttcaggaaaaa

SEQ ID NO: 5840 - protein, 54 aa, Neisseria gonorrhoeae
VDFSIKLNKKCHLVQIFSIYFLFIKSKRLLFAILSSRFENVYNCPRYLQKFQEK

SEQ ID NO: 5841 - DNA, 624 bp, Neisseria gonorrhoeae
atgccgtctgaacggcttggagcgcgttcgaacggctgcccgcctaccttatcttaccgaaagaacaatatgatcaacgatattcaaaaaacagccgaaggcaagatgcagcgttcggtcgaagtactgaaagaaaatctggcgaaagtgcgtaccggccgcgcgcataccggcctgctcgaccaagtggaagtcgaatactggggcagcatggtccccgtcagccaggttgccaacgtaacccttttggacgcgcgcaccatcggcgtgaaaccgtttgagggcaatatggcggccaaagtcgagaaagccatccgcgattcaaacttgggactgaacccggcagctgtcggcgatttgatccgcgtgccgatgcccatgctgaccgaggaacgccgcaaagacctgattaaagtcgtgcgcggcgaggcggaagaaggacgcgtctctatccgcaacgtgcgccgcgatgccaacgaccacatcaaaaaactcctcaaagacaaagaaatttccgaagacgaggcacgtcgcggcgaagaggcggttcaaaaactgaccgacaagtacattgccgaagccgataaggttttggctgccaaagaagaagacctgatggcggtt

SEQ ID NO: 5842 - protein, 208 aa, Neisseria gonorrhoeae
MPSERLGARSNGCPPTLSYRKNNMINDIQKTAEGKMQRSVEVLKENLAKVRTGRAHTGLLDQVEVEYWGSMVPVSQVANVTLLDARTIGVKPFEGNMAAKVEKAIRDSNLGLNPAAVGDLIRVPMPMLTEERRKDLIKVVRGEAEEGRVSIRNVRRDANDHIKKLLKDKEISEDEARRGEEAVQKLTDKYIAEADKVLAAKEEDLMAV

SEQ ID NO: 5843 - DNA, 414 bp, Neisseria gonorrhoeae; identical to SEQ ID NO: 129

SEQ ID NO: 5844 - protein, 138 aa, Neisseria gonorrhoeae; identical to SEQ ID NO: 130

SEQ ID NO: 5845 - DNA, 450 bp, Neisseria gonorrhoeae
atgtttatggctattgcgaacaataaaaaagcatttcacgattttttcattgaagaccggattgaagccggtttggtcttggaaggctgggaagtcaaagcaatccgcgccgcgcgcgtacagcttaaagagagttatatctattggaaaaaagatgcgttttatctggtcggctgccatattacggctttgcctacggcttcgacacacatcaaaccggatgccgtacgtccgcgcaaactgttattaaaacagtcggaaatcaataagttaatcggaaaaaccgaacgtgcaggttacaccatcgtgccgctggatttgcatttttcacgcggaaaaatcaagatggaaatcggtttggcaaaaggtaagaaacagcacgataaacgacaaagtatgaaggaagccgactggaaacgcgagaaacagcggttgattaagcatacgcgc

SEQ ID NO: 5846 - protein, 150 aa, Neisseria gonorrhoeae
MFMAIANNKKAFHDFFIEDRIEAGLVLEGWEVKAIRAARVQLKESYIYWKKDAFYLVGCHITALPTASTHIKPDAVRPRKLLLKQSEINKLIGKTERAGYTIVPLDLHFSRGKIKMEIGLAKGKKQHDKRQSMKEADWKREKQRLIKHTR

SEQ ID NO: 5847 - DNA, 1008 bp, Neisseria gonorrhoeae
atgtctatcaaaatcctgattatttctcccagttggataggcgactgcgtgatgacccagcccttgttccgccgtttgaagaaacttcatcccggttgcacgattgatgtgttcgcaccgaagtggtcgatggcggtgttcgagcgtatgccggaagtgaatgagattcttgaaaatccgttcggacacggtgcgttggagctgaaacgccgttggcgggtcggcagggagttgggacggcgcggatacgacagggttatcgtgttgccgggttctttgaagtcggcagtcatcgcgctggcaacgggcatcggaaaaagaacgggttatgtcggcgaaagccgttattttctgttgaacgatatacgcaggctggataaggaacgtctgcctttgatggtggaccgatatacggctctcgcgcatcagagtcaggaagattttgacgggcattcgggattccccgagttttccattgatgaacggcggcgggaaatttctgtcgaaactttcggtttgaatcttggaaagcctgttctggctttttgcccgggtgcggaattcgggccggcaaagcgttggccggcaaggcattttgccgagttgggcaaacactattcggaggcgggttggcaggtttggttgttcggttcgcaaaaagataatgaaatcgccgaagaaatcaactgcctttcagacggcatgtgtgtcaatttgtgcggcaaaaccgatttgtcgcaggcaatggatttgctgtcgttggcggacacggtcgtgtgcaacgacagcgggctgatgcatttggcggctgctttgggcaggaaggtagtggcggtttacggttcttccagcccgacgcatacgccgcctttgagcgacagggcgaaaatcgtcagcctgcacttggaatgttcgccctgtttcaaacgtgaatgcccgttggggcataccgactgcctcaacaggctgtatcccgagaagattgtgcaggcggttgaagaggcggta

SEQ ID NO: 5848 - protein, 336 aa, Neisseria gonorrhoeae
MSIKILIISPSWIGDCVMTQPLFRRLKKLHPGCTIDVFAPKWSMAVFERMPEVNEILENPFGHGALELKRRWRVGRELGRRGYDRVIVLPGSLKSAVIALATGIGKRTGYVGESRYFLLNDIRRLDKERLPLMVDRYTALAHQSQEDFDGHSGFPEFSIDERRREISVETFGLNLGKPVLAFCPGAEFGPAKRWPARHFAELGKHYSEAGWQVWLFGSQKDNEIAEEINCLSDGMCVNLCGKTDLSQAMDLLSLADTVVCNDSGLMHLAAALGRKVVAVYGSSSPTHTPPLSDRAKIVSLHLECSPCFKRECPLGHTDCLNRLYPEKIVQAVEEAV

SEQ ID NO: 5849 - DNA, 867 bp, Neisseria gonorrhoeae
ttgccgcaaccagaccctcaaggtttccgccgcagcctgttcctgtaccggcgtgcgggaatggcggaaatcggggatttcgccgtcaaatttatgatagggatacggagcaaacgaatgattaccctgccttccttaaacaatctgccgtcaaaatgggatgaaatccgccattgcctcgaaacccgggtttttgagtgcggcgttatgccgtatcccaatctgacggaatgcgaagccgggcagttcgagcgggatttttgggacaatatcggctgcgcgcctgaagaatatgtccgtatccgccgcgccatccgtctgttggaattacgttatcccgacagcttgaacgagctggtgtgtgccgctattgccacgcctttgggcgagatgttggcggtgttcggcgttaagggattgtgcctgctggagtttgtcggacagaagtatttggaacaggaaattgccgccgtccaaaaagccttgcgcggacggtttgtgtttcgggaagacgggcggatgcaatttttgcgtcaggaattggacttatacttcaagggtcatctgaaaacctttgccacgcctttggagcagattggcaccgagtttcaaaagcaggcatgggacgcgctcttggcgattccttacggcgaaacgcgcagctacaaagagcaggcgcagcgtttgggcaaccccaaagccgtccgcgccgttgccgccgccaacgggcagaacaaggtgtctgtcatgattccctgccaccgcgtcatcggcagcgacggcaaactgaccggctacgcgggcgggttgaaccgcaaacagtttttactggctttggaacgcggcgaagttcagacggcattgttt

SEQ ID NO: 5850 - protein, 289 aa, Neisseria gonorrhoeae
LPQPDPQGFRRSLFLYRRAGMAEIGDFAVKFMIGIRSKRMITLPSLNNLPSKWDEIRHCLETRVFECGVMPYPNLTECEAGQFERDFWDNIGCAPEEYVRIRRAIRLLELRYPDSLNELVCAAIATPLGEMLAVFGVKGLCLLEFVGQKYLEQEIAAVQKALRGRFVFREDGRMQFLRQELDLYFKGHLKTFATPLEQIGTEFQKQAWDALLAIPYGETRSYKEQAQRLGNPKAVRAVAAANGQNKVSVMIPCHRVIGSDGKLTGYAGGLNRKQFLLALERGEVQTALF

SEQ ID NO: 5851 - DNA, 219 bp, Neisseria gonorrhoeae
atgaatccacttattcatcaagcaaaggaatcatctatgcaaacccgcatcctctccgccgtactgctggctttttcaaccgctgcctttgccgggggcgcattcacgctgcaattcgacaacccgtccgaagacggcggcttcacgcaaaaccagcttttgagcgcgccttacggcttcggctgttcgggcggcaatgcttcgcccgcgctgtcgtgg

SEQ ID NO: 5852 - protein, 73 aa, Neisseria gonorrhoeae
MNPLIHQAKESSMQTRILSAVLLAFSTAAFAGGAFTLQFDNPSEDGGFTQNQLLSAPYGFGCSGGNASPALSW

SEQ ID NO: 5853 - DNA, 483 bp, Neisseria gonorrhoeae
ttgagggtctggttgcggcaatgcctaaatatacaatatttccaaagcatcagggaaaggaatgtttcaacacacaggacgacacataaagcgtcgccctatgaaaaatttcagacggccttcaaagggtcgtctgaaaccacgatttttgcatttgcgcattccggcacatcatccaaccgtttcggcacattcctgccgccgttgacagcctataatgaatccacttattcatcaagcaaaggaatcatctatgcaaacccgcatcctctccgccgtactgctggctttttcaaccgctgcctttgccgggggcgcattcacgctgcaattcgacaacccgtccgaagacggcggcttcacgcaaaaccagcttttgagcgcgccttacggcttcggctgttcgggcggcaatgcttcgcccgcgctgtcgtggtaaaacccgcccgcagggacaaaaagtttcgtcctgaccgtttacga

SEQ ID NO: 5854 - protein, 161 aa, Neisseria gonorrhoeae
LRVWLRQCLNIQYFQSIRERNVSTHRTTHKASPYEKFQTAFKGSSETTIFAFAHSGTSSNRFGTFLPPLTAYNESTYSSSKGIIYANPHPLRRTAGFFNRCLCRGRIHAAIRQPVRRRRLHAKPAFERALRLRLFGRQCFARAVVVKPARRDKKFRPDRLR

SEQ ID NO: 5855 - DNA, 453 bp, Neisseria gonorrhoeae; identical to SEQ ID NO: 131

SEQ ID NO: 5856 - protein, 151 aa, Neisseria gonorrhoeae; identical to SEQ ID NO: 132

SEQ ID NO: 5857 - DNA, 2199 bp, Neisseria gonorrhoeae
ttgcctgcctgtatgatctaccatcgcatcgctgtaaacgtgccgctttcagacggccttttgacttattcgcattccgagccgcttcctccgggaacgcgggtgcttgtgccttttcgcaataaaactgttgtcgggatggtgtgggaaacggatattgcgcccgatatggatgcggcgcggattttgagcgttcagacggtctttgtggaagaaaagccgctgtctcaaagctggcgtgatttgttggcgtttacgtcgcgttattaccactatccgactgggcaggctgtatttgccgcattgccgcagggtttgaaggaaacgcgcgcggtggaaatgccgcagccgccgttgttttatgctttgaacgaagcgggcagggcgcaaacgccgccgccggctcggttcaacaaaaaagcggctttgtgggacgcgctgctgtcgggcgaaatgacgatggcggcgttgaaacaggcaaacgcgcaggcggcgaaattgattgaggattgggcggagcagggctggattgaaacgacggaagcggcgaaacctgttttaaggccgtaccgcgggcaggcttcgcactctgaatttgtattaaataccggccagcagaaggcttccgatgaaattcagacggcattgggacgcttccggtcgtttctgctgtacggcattaccggcagcggcaagaccgaggtgtatttcgatgcgatggcgaaagtgttggcgcaggggcgacaggtgttgtttctgttgcccgaaatcaacctcacgccgcagcttttaaagcgggtggaaaaccgttttgccgacgtgccgaccgccgtgttgcacagccggatggcggcaggcaggcgcacgcaggattatctgcgcgcgatgttggggcaggcgaagctggtgatcggcacgcggctggcggtgtttacgcctttgcctgatgtcgggctgattgtggtcgatgaggaacacgacggctcgttcaaacaagacaacgaattgcgctaccacgcccgcgatttggcggtgtggcgggcgaagcagggcggctgtcccgtcgtgttgggcagtgccacgcccagcttggagagttggcacaaggcgcaaagcggcgcgtaccgcctgctgcaactgaccgaacgcgcccatgcttccgcgcaactgccacaagtggacatcctcaacataggtcgtctgaaactcgataacggcttctcaccgcaagccttgcagcttttgaaacagaactttgaagcgggcggtatgtcgctggtgtaccttaaccggcgcggcttcgcgcctgcgctgttttgcggcgactgcggccataccttcggctgcccgaactgctccgccaaaatggtgctgcaccaacgcgcccgccaactgcgctgccaccactgcgaccaccgcgaacccatcccgttcaaatgtcccgactgcggcaaccaagacctgaccgccgtcggacacggtacgcagcgcgtcgaagaaaccctgcgcgccttcctgcccaaggcagccgtcgtccgcgtcgatagggacagtacggcgcacaaaaacgactgggcagatttgtaccgccgcatcgccaacgacgaaatcgacattctggtcggcacgcagatgcttgccaaaggccatgatttcgcgcggctcaacctcgttatcgtgttgaacgccgacggcagcctgtacagcgcggatttccgtgcgccggaaaggctgtttgccgagctgatgcaagtgtccggcagggcggggcgcgccgacaaacccggcaaggtgctgatacagacccaactgcccgaacaccctgtcttcgccgccgtcaaagcgcaggactacgccgtgtttgccgaaaacgaattgaacgaacggcaaatgttcgccatgccgcctttcggttttcagacggccgtccgtgccgatgcgccgcgtgttgccgatgcgatggaatttctcaacgccgccaaagaaaccctcgccccgctcttgcccgaaagcgtctcccggttcggtgccgccccgatgctgatggtgcgccttgccgaacgcgaacgtgcgcaagttttcctcgaatcaacatcccgacaagatttgcaccgcgccgtgagtttgtgggtgcaggtgttgcagcagaaccgcgacggcaaaatccgatggtcggtggatgtcgatccgcaggaggct

SEQ ID NO: 5858 - protein, 733 aa, Neisseria gonorrhoeae
LPACMIYHRIAVNVPLSDGLLTYSHSEPLPPGTRVLVPFRNKTVVGMVWETDIAPDMDAARILSVQTVFVEEKPLSQSWRDLLAFTSRYYHYPTGQAVFAALPQGLKETRAVEMPQPPLFYALNEAGRAQTPPPARFNKKAALWDALLSGEMTMAALKQANAQAAKLIEDWAEQGWIETTEAAKPVLRPYRGQASHSEFVLNTGQQKASDEIQTALGRFRSFLLYGITGSGKTEVYFDAMAKVLAQGRQVLFLLPEINLTPQLLKRVENRFADVPTAVLHSRMAAGRRTQDYLRAMLGQAKLVIGTRLAVFTPLPDVGLIVVDEEHDGSFKQDNELRYHARDLAVWRAKQGGCPVVLGSATPSLESWHKAQSGAYRLLQLTERAHASAQLPQVDILNIGRLKLDNGFSPQALQLLKQNFEAGGMSLVYLNRRGFAPALFCGDCGHTFGCPNCSAKMVLHQRARQLRCHHCDHREPIPFKCPDCGNQDLTAVGHGTQRVEETLRAFLPKAAVVRVDRDSTAHKNDWADLYRRIANDEIDILVGTQMLAKGHDFARLNLVIVLNADGSLYSADFRAPERLFAELMQVSGRAGRADKPGKVLIQTQLPEHPVFAAVKAQDYAVFAENELNERQMFAMPPFGFQTAVRADAPRVADAMEFLNAAKETLAPLLPESVSRFGAAPMLMVRLAERERAQVFLESTSRQDLHRAVSLWVQVLQQNRDGKIRWSVDVDPQEA

SEQ ID NO: 5859 - DNA, 198 bp, Neisseria gonorrhoeae
ttgcgtaccgtcggtggtccgctcggaagcggagccggcggcatatcggcgcacggggcaggtcagcgtcggtgttcgaccgtgaatttcgcttcgcccaagctgtttgccttagtggagaaaccgaccagcacgggtgtggattcggcggtgatgttcggcagcttggcgactttcagcgcggtaagcgtgaattcg

SEQ ID NO: 5860 - protein, 66 aa, Neisseria gonorrhoeae
LRTVGGPLGSGAGGISAHGAGQRRCSTVNFASPKLFALVEKPTSTGVDSAVMFGSLATFSAVSVNS

SEQ ID NO: 5861 - DNA, 99 bp, Neisseria gonorrhoeae
gtgcgccgatatgccgccggctccgcttccgagcggaccaccgacggtacgcaaccgaacagctctttgaagcgcgcgctgaaacgggacgggcagtca

SEQ ID NO: 5862 - protein, 33 aa, Neisseria gonorrhoeae
VRRYAAGSASERTTDGTQPNSSLKRALKRDGQS

SEQ ID NO: 5863 - DNA, 375 bp, Neisseria gonorrhoeae
gtgtttcctgccttcgggaggacacgcgccgccgtagcccggcgcgccgaagtccgtgcgggtttgcagcgcgcctttgggcggcctgcctcattgtgcggtaatgcctgcgggcaggcggcggacatcggcgggaatgtcggcgaccacccagtgcatccggtccagaccgatcggcgcgtctttatcgtaaacggtcaggacgaaactttttgtccctgcgggcgggttttaccacgacagcgcgggcgaagcattgccgcccgaacagccgaagccgtaaggcgcgctcaaaagctggttttgcgtgaagccgccgtcttcggacgggttgtcgaattgcagcgtgaatgcgcccccggcaaaggcagcggt

SEQ ID NO: 5864 - protein, 125 aa, Neisseria gonorrhoeae
VFPAFGRTRAAVARRAEVRAGLQRAFGRPASLCGNACGQAADIGGNVGDHPVHPVQTDRRVFIVNGQDETFCPCGRVLPRQRGRSIAARTAEAVRRAQKLVLREAAVFGRVVELQRECAPGKGSG

SEQ ID NO: 5865 - DNA, 861 bp, Neisseria gonorrhoeae
ttgaggaatataaccgtgccgtcaaattactttcatacgcgtgaacgattgggtgctttaggcggcatcgtgcaacatcataccgccttgtaccgcagcgtggcggtatatgaaccgaccgtggttatcgtgcggcgcggatgcaagaagctgcggtgggcggggcgcgaattgaggattgcggcgggtgaggctgtcggcttggcaggcgggcagacgcttgacgtcatcaatattcccgattcagacggcctctatcaggcgcaatggattgctttcgaacaggaaaccgtagaaaggttcgccgcacaatacgggacggcgcaggcagtgtgcgatgcggtgaagctgccgcaccccgggcgtatgggcgcggcgtttgattatgcggctgcggtactggcggatgaagaagtgccgcacaatgcggcggaggccgcgctttgcggcgtgttggcgtggttgcagcatgacggcatcggttttgccgtgtacggaggcgtcaacctgatgcggcaaatccgcaaactgattactgccgatatggctgcggactggtcgtcggcaatgctggcgcagcggcttaattgcagcgaggccgcgttgcggcggcggttggcgcggcaggacacgaatttccgtacgctgctgacggatgtacgcatgatgcgcgcgctgacgctgttgcaggttacgcaatggtcggtagcgcagattgccggcgcggttggctatgactgcccgtcccgtttcagcgcgcgcttcaaagagctgttcggttgcgtaccgtcggtggtccgctcggaagcggagccggcggcatatcggcgcacggggcaggtcagcgtcggtgttcgaccg

SEQ ID NO: 5866 - protein, 287 aa, Neisseria gonorrhoeae
LRNITVPSNYFHTRERLGALGGIVQHHTALYRSVAVYEPTVVIVRRGCKKLRWAGRELRIAAGEAVGLAGGQTLDVINIPDSDGLYQAQWIAFEQETVERFAAQYGTAQAVCDAVKLPHPGRMGAAFDYAAAVLADEEVPHNAAEAALCGVLAWLQHDGIGFAVYGGVNLMRQIRKLITADMAADWSSAMLAQRLNCSEAALRRRLARQDTNFRTLLTDVRMMRALTLLQVTQWSVAQIAGAVGYDCPSRFSARFKELFGCVPSVVRSEAEPAAYRRTGQVSVGVRP

SEQ ID NO: 5867 - DNA, 1233 bp, Neisseria gonorrhoeae
atgcccgtcttatacaccaatccaacccggaggtcgtctgaaaatcagcttcaggacatttcagacgacctgatttccaaagtgaacaaaatgaccgaaacccaatccctagaactcgccaaagcgttgatttcccgcccgtccgttacccccgacgaccgagattgccaaaaactgcttgccgaacgcctgcacaaaatcggttttgcggctgaagaactccatttcggcgacaccaaaaacatctggttgcgacgcggcacgaaagctcccgtcgtctgttttgcagggcataccgacgttgtgccgacaggtcctgttgaaaaatgggattcgcccccgttcgaaccgaccgagcgcgacggaagattatacgggcgcggcgcggcggacatgaaaaccagcatcgcctgtttcgttaccgcctgcgaacgctttgttgccgaacatcccgaccatcaaggcagcattgcactcttgattacttccgacgaagagggcgatgcactggacggcacgaccaaagtcgtcgatgtgttgaaagcacgcggagagttgattgactactgcatcgtcggcgaaccgaccgccgtggacaaattgggcgatatgattaaaaacggccggcgcggctcgctgtcgggcagcctgaccgtcaaaggcaagcaagggcatattgcttatcctcatttggcggtgaatcccatacatacttttgccccggccttgttagagctgacgcaggaaatttgggatgaaggcaacgaatatttcccgccgaccagctttcaaatttccaatatcaacggcggcacaggcgcgaccaacgtcattccgggcgagctgaacgtcaaatttaatttccgcttctccacagagtccaccgaaacagggctgaaacaacgcgtccacgccattttggacaaacacggcgtgcaatacgatttgcagtggtcgtgttcgggacagcccttcctgacccacgcgggcaaactgaccgacgtggcacgcaccgccattgccgaaacctgcggcgttgaggccgaattgtccaccaccggcggcacttcggacggacgcttcattaaagccattgcgaaagaactcatcgaattaggcccgtccaatgccaccatccaccaaatcaacgaaaatgtgcggctggacgatattccgaagctgtcggcggtgtatgagaggatattggcgcggttgttggctgaaaaggccgtc

SEQ ID NO: 5868 - protein, 411 aa, Neisseria gonorrhoeae
MPVLYTNPTRRSSENQLQDISDDLISKVNKMTETQSLELAKALISRPSVTPDDRDCQKLLAERLHKIGFAAEELHFGDTKNIWLRRGTKAPVVCFAGHTDVVPTGPVEKWDSPPFEPTERDGRLYGRGAADMKTSIACFVTACERFVAEHPDHQGSIALLITSDEEGDALDGTTKVVDVLKARGELIDYCIVGEPTAVDKLGDMIKNGRRGSLSGSLTVKGKQGHIAYPHLAVNPIHTFAPALLELTQEIWDEGNEYFPPTSFQISNINGGTGATNVIPGELNVKFNFRFSTESTETGLKQRVHAILDKHGVQYDLQWSCSGQPFLTHAGKLTDVARTAIAETCGVEAELSTTGGTSDGRFIKAIAKELIELGPSNATIHQINENVRLDDIPKLSAVYERILARLLAEKAV

SEQ ID NO: 5869 - DNA, 618 bp, Neisseria gonorrhoeae
atgctgacgcccaaaagctgcgatttgttcaatatcccgtttttccagtttgcccagctcaaaaaataccagcccgagagcattccgcaaatcaaagccgactacaaggaaaactggcagatatggcagcagttgatacagcaggtcgccgcagatttgagcgaacctttcgccccgccgcatatcgaacgctggtgtaacggctggcaggttcgcgcccatttcttcgcctacttcaaatacgcccaatacaaaaattccgccgccatcctgtcgatactgctcaaccgccgccgcctgagcgtcagcttggactggcattgctacaaagccgacgtgtcgccgattgcgctgcccgagtacaaccgctggctggatgatttcgataccgaaaaatacgccgcattcgatatgtggcacggcgcggaaagcgaatatgacgattaccgcaccgtcgcacaacaaagcgaatccgaccgaaggttgcaaaacgacgaagactttttctgcatcggcaaacacattgagcgcgacgatttgggcaagcaggatgtagcaaaatggatagccgaaacggtggaagatttactgccgctttacgaagcctgtcacggcaaa

SEQ ID NO: 5870 - protein, 206 aa, Neisseria gonorrhoeae
MLTPKSCDLFNIPFFQFAQLKKYQPESIPQIKADYKENWQIWQQLIQQVAADLSEPFAPPHIERWCNGWQVRAHFFAYFKYAQYKNSAAILSILLNRRRLSVSLDWHCYKADVSPIALPEYNRWLDDFDTEKYAAFDMWHGAESEYDDYRTVAQQSESDRRLQNDEDFFCIGKHIERDDLGKQDVAKWIAETVEDLLPLYEACHGK

SEQ ID NO: 5871 - DNA, 507 bp, Neisseria gonorrhoeae
atgaatccgtttgaaacccaaagcgttacctttgccgaaccgattgaaatgctgtatgcctgccacggcaaagtgcgccgtttttgcggtcagattgctatgttgtcgggctatatcgccgaaaacggctgcaatcagcttgttttgcaaaccatccgccaaatctcccggtatttcaacgttgccgcgccgctgcaccatgaggacgaagaagaaaactttttcccgctgctgctgcaatacgcgccgcaagcccgtgaaggcgtggacgagctgttgcgccaacatatcgggctgtacgacaactgggcggctgtttccgccgaatttgccaaactcgaagcagacaacgcttatatccccgatgcggaagcgttcaaacgctttgtggagggatatgatgtgcatctggcgattgaagagcctttgttcgacatgggcaaaacgtttatccccgaagagaagctgaccgaaatcggcaaaatcatggcggcgcgccggtgcaaa

SEQ ID NO: 5872 - protein, 169 aa, Neisseria gonorrhoeae
MNPFETQSVTFAEPIEMLYACHGKVRRFCGQIAMLSGYIAENGCNQLVLQTIRQISRYFNVAAPLHHEDEEENFFPLLLQYAPQAREGVDELLRQHIGLYDNWAAVSAEFAKLEADNAYIPDAEAFKRFVEGYDVHLAIEEPLFDMGKTFIPEEKLTEIGKIMAARRCK

SEQ ID NO: 5873 - DNA, 612 bp, Neisseria gonorrhoeae
ttgagacgattgtttcagacggcattatttgcaccggcgcgccgccatgattttgccgatttcggtcagcttctcttcggggataaacgttttgcccatgtcgaacaaaggctcttcaatcgccagatgcacatcatatccctccacaaagcgtttgaacgcttccgcatcggggatataagcgttgtctgcttcgagtttggcaaattcggcggaaacagccgcccagttgtcgtacagcccgatatgttggcgcaacagctcgtccacgccttcacgggcttgcggcgcgtattgcagcagcagcgggaaaaagttttcttcttcgtcctcatggtgcagcggcgcggcaacgttgaaataccgggagatttggcggatggtttgcaaaacaagctgattgcagccgttttcggcgatatagcccgacaacatagcaatctgaccgcaaaaacggcgcactttgccgtggcaggcatacagcatttcaatcggttcggcaaaggtaacgctttgggtttcaaacggattcatgttttcgttctcaacggggacttttcaagcagtcattttataataaaacagcctgcacaaagcaggctgtctgtcttt

SEQ ID NO: 5874 - protein, 204 aa, Neisseria gonorrhoeae
LRRLFQTALFAPARRHDFADFGQLLFGDKRFAHVEQRLFNRQMHIISLHKAFERFRIGDISVVCFEFGKFGGNSRPVVVQPDMLAQQLVHAFTGLRRVLQQQREKVFFFVLMVQRRGNVEIPGDLADGLQNKLIAAVFGDIARQHSNLTAKTAHFAVAGIQHFNRFGKGNALGFKRIHVFVLNGDFSSSHFIIKQPAQSRLSVF

SEQ ID NO: 5875 - DNA, 771 bp, Neisseria gonorrhoeae
ttgaacgccgaaccgcgaaaggcagatatgaagagcagcacgcagaccattttggaacacaccgccatcccgaggcacatcgccgtaattatggacggcaacggccgttgggcgaaaaaacgttttctcccgcgtataatgggacacaaacgcggcttggacgcgttggaaaatatggtgaagcattgcgccaaactgggcgtgcaatatctgaccgtgtttgccttttcaaccgaaaactggcgtcgccccgaagacgaagtttcgttcctgatggggctgtttttacaggctttgcaaaaacaggtacgccgcctgcacgaaaacaatatgcgcctgaaaatattgggcagccgcgaacgctttaatcggcagattctgcaaggtatcgaagaggcggaagccttgacggcaaataataccggtctgaccctgagcattgctgcggattacggcggccgctgggatattttgcaggcggcaaacaaactgattgccgaaggcgtatccgagattacggaagacacgctggccaaacacttgatgctgggcgacgcgccggaaccggatttgttcatccgcacgggcggagaaacgcgcatcagcaatttcctgctctggcagatggcgtatgcagaactgtatttcaccgacatcctgtggcccgatttcgacgaaaccgccttagatgccgccgtcgcttcgttccaaaaacgcgaacggcggttcggacgcacttccgagcaactgcctatcggacagcaaaggaac

SEQ ID NO: 5876 - protein, 257 aa, Neisseria gonorrhoeae
LNAEPRKADMKSSTQTILEHTAIPRHIAVIMDGNGRWAKKRFLPRIMGHKRGLDALENMVKHCAKLGVQYLTVFAFSTENWRRPEDEVSFLMGLFLQALQKQVRRLHENNMRLKILGSRERFNRQILQGIEEAEALTANNTGLTLSIAADYGGRWDILQAANKLIAEGVSEITEDTLAKHLMLGDAPEPDLFIRTGGETRISNFLLWQMAYAELYFTDILWPDFDETALDAAVASFQKRERRFGRTSEQLPIGQQRN

SEQ ID NO: 5877 - DNA, 126 bp, Neisseria gonorrhoeae
ttgattaacttggttttcatatcaaagatgattgagcgtgttggaaaagtggcattgtatcaaacctctgttgcgcctgcattgcgccgaggctcaatttatcgtctgaaaatagcttccggctgt

SEQ ID NO: 5878 - protein, 42 aa, Neisseria gonorrhoeae
LINLVFISKMIERVGKVALYQTSVAPALRRGSIYRLKIASGC

SEQ ID NO: 5879 - DNA, 603 bp, Neisseria gonorrhoeae
ttgcactttgatttccgtaaaaccgaatattattttatcgattggagatttaccatgaaagcttatctggctctgatttctgccgccgttatcggtttggctgcctgctctcaagaacctgccgcgcctgctgccgaggcaactcctgccggtgaagcacccgcttccgaagcgcctgccgccgaagctgctcctgcagatgctgccgaagcccctgctgccggcaactgtgcggcaactgtcgaatccaacgacaatatgcagttcaacaccaaagacatccaagtcagcaaagcatgtaaagagttcaccatcactctgaaacataccggtacgcaacccaaagccagcatgggtcacaaccttgtgattgccaaagctgaagacatggacggcgtatttaaagacggcgtaggtgctgccgataccgactatgtcaaacctgacgatgcgcgcgttgttgcccacaccaaactgatcggcggcggcgaagagtcttccctgactttggatcctgccaaattggctgacggcgactacaaatttgcctgcaccttcccgggtcacggtgctttgatgaacggcaaagtgactttggtcgat

SEQ ID NO: 5880 - protein, 201 aa, Neisseria gonorrhoeae
LHFDFRKTEYYFIDWRFTMKAYLALISAAVIGLAACSQEPAAPAAEATPAGEAPASEAPAAEAAPADAAEAPAAGNCAATVESNDNMQFNTKDIQVSKACKEFTITLKHTGTQPKASMGHNLVIAKAEDMDGVFKDGVGAADTDYVKPDDARVVAHTKLIGGGEESSLTLDPAKLADGDYKFACTFPGHGALMNGKVTLVD

SEQ ID NO: 5881 - DNA, 585 bp, Neisseria gonorrhoeae
gtgacccgggaaggtgcaggcaaatttgtagtcgccgtcagccaatttggcaggatccaaagtcagggaagactcttcgccgccgccgatcagtttggtgtgggcaacaacgcgcgcatcgtcaggtttgacatagtcggtatcggcagcacctacgccgtctttaaatacgccgtccatgtcttcagctttggcaatcacaaggttgtgacccatgctggctttgggttgcgtaccggtatgtttcagagtgatggtgaactctttacatgctttgctgacttggatgtctttggtgttgaactgcatattgtcgttggattcgacagttgccgcacagttgccggcagcaggggcttcggcagcatctgcaggagcagcttcggcggcaggcgcttcggaagcgggtgcttcaccggcaggagttgcctcggcagcaggcgcggcaggttcttgagagcaggcagccaaaccgataacggcggcagaaatcagagccagataagctttcatggtaaatctccaatcgataaaataatattcggttttacggaaatcaaagtgcaaccgccattaacaaaacct

SEQ ID NO: 5882 - protein, 195 aa, Neisseria gonorrhoeae
VTREGAGKFVVAVSQFGRIQSQGRLFAAADQFGVGNNARIVRFDIVGIGSTYAVFKYAVHVFSFGNHKVVTHAGFGLRTGMFQSDGELFTCFADLDVFGVELHIVVGFDSCRTVAGSRGFGSICRSSFGGRRFGSGCFTGRSCLGSRRGRFLRAGSQTDNGGRNQSQISFHGKSPIDKIIFGFTEIKVQPPLTKP

SEQ ID NO: 5883 - DNA, 489 bp, Neisseria gonorrhoeae
gtgttgcacaaacagatgtttcggggcggcattttgctacaaacttcatttgaaatcaaagcctgtttgcaagtttacaatcgtttacccaaaaaaagggcaatcttaccccgaacctatttctttaatattagggcagccgtcccccgccgcgcaaatattaacggatatttacaacatccctgccggccgccttatgccccgtacttcctgaccagctcctccagtgcctccgccaattcgggatgccgttcttccaactttgccgccgccgaatcgaaactctccaacgcagccttactcaaatgcagggtattggttttcggcggtttttccggttttggaaccagcctgaccgaaacagaccgtatcgaagcatcaagccctgccagctgcggcaataccgacggggcaatcatcttcaaacgcgatgccgccatattgtttgccgccaaaaggacaagcctgccgtcttcgatacatgccgtc

SEQ ID NO: 5884 - protein, 163 aa, Neisseria gonorrhoeae
VLHKQMFRGGILLQTSFEIKACLQVYNRLPKKRAILPRTYFFNIRAAVPRRANINGYLQHPCRPPYAPYFLTSSSSASANSGCRSSNFAAAESKLSNAALLKCRVLVFGGFSGFGTSLTETDRIEASSPASCGNTDGAIIFKRDAAILFAAKRTSLPSSIHAV

SEQ ID NO: 5885 - DNA, 420 bp, Neisseria gonorrhoeae
atgaatttggaacagttgggcaggcgggacgcgctgctttccggacttttgaaacaggcgggacagtggcggcggttggatgctgccgtgaaaaaactgctgcctgccaacctgcacccccactttcagacggcatgtatcgaagacggcaggcttgtccttttggcggcaaacaatatggcggcatcgcgtttgaagatgattgccccgtcggtattgccgcagctggcagggcttgatgcttcgatacggtctgtttcggtcaggctggttccaaaaccggaaaaaccgccgaaaaccaataccctgcatttgagtaaggctgcgttggagagtttcgattcggcggcggcaaagttggaagaacggcatcccgaattggcggaggcactggaggagctggtcaggaagtacggggca

SEQ ID NO: 5886 - protein, 140 aa, Neisseria gonorrhoeae
MNLEQLGRRDALLSGLLKQAGQWRRLDAAVKKLLPANLHPHFQTACIEDGRLVLLAANNMAASRLKMIAPSVLPQLAGLDASIRSVSVRLVPKPEKPPKTNTLHLSKAALESFDSAAAKLEERHPELAEALEELVRKYGA

SEQ ID NO: 5887 - DNA, 2196 bp, Neisseria gonorrhoeae
atgctgacaaacattgccaagaaaatcttcggcagccgcaacgaccgcttgctgaaacaataccgtaaatccgttgccagaatcaacgcgctcgaagaacagatgcaagccctaagcgatgctgatctgcaagccaaaactgccgaattcaaacaacgcctcgccgacggtcagactttggacggcattttgcccgaagccttcgccgtctgccgcgaagcgtcccgccgcgtactcggtatgcgccacttcgacgtgcagcttatcggcggtatggtgctgcacgacggcaaaatcgccgaaatgcgtaccggcgaaggcaaaaccctggtcgccaccctcgccgtctatctcaacgcgctggccggcaaaggcgtgcacgtcgttaccgtcaacgactacctcgcctcgcgcgacgcaggcattatggagccgctctacaatttcctcggtctgaccgtcggcgtgattatttcagatatgcagccgttcgaccgtcaaaacgcctacgctgccgacattacctacggcacgaacaacgaattcggcttcgactacctgcgcgacaatatggtaaccgaccaatacgacaaagtgcagcgcgaattgaattttgccgttgtcgatgaagtggactccatcttgattgacgaagcgcgcaccccgctgattatctccggtcaggcagacgacaacatccagctctaccaaatcatgaacaccgttccgccccacctcgtccgtcaagagacagaagaaggcgaaggcgactattgggtcgacgaaaaggcacatcaggtcatcctgagcgaaacaggtcacgaacacgccgaacaaatcctgacccaaatggggctgctggcagaaaacgactcgctgtactcggcggcaaatatctccctgatgcaccaccttatggcagcattacgcgcgcactcgctgttccacaaagaccaacattacgttatccaagacggcgaaatcgtcatcgttgacgaatttacaggccgtctgatgtccggccgccgctggtccgaaggcctgcatcaagccgtagaagccaaagaaggcgtggaaatcaaacgcgaaaaccaaaccctcgcctccatcaccttccaaaactatttccgcctgtacaccaagctctccggtatgaccggtacggcagataccgaggctttcgagttccaaagcatctacaacctcgaaaccgtcatcatcccgaccaaccgccccgtacagcgcaaagacctcaacgaccagattttccgttccgccgaagaaaaattcgaagccgtcgtcaaagacatcgaggaatgccacaaacgcgggcagcccgtcctcgtcggtacgaccagcatcgaaaactccgaactggtctcccgccttctgcaaaaagccggactgccgcacaacgtcctcaacgccaaagaacacgaacgcgaagccctgattgtcgcccaagccggcaaagtcggcgcaattaccgtcgccaccaatatggcgggacgcggtacggacatcgttttaggcggcaacctgaagcaccaaaccgatgccatccgcgccgacgaaaccttgagcgacgaagagaaacaggcacaaatcgccgcactcgaaaacggctggcaggcagaacacgataaagtgatggaagcaggcggtttgcacatcatcggtacggaacgccacgaaagccgccgtatcgacaaccagttgcgcggacgttccggccgtcagggcgaccccggatccagccgtttctacctctcgtttgaagacccgctgttgcgcctcttcgcactcgaccgcgccgccgccatcctcaaccgcctcgcccccgaacgcggcgttgccatcgagcacaacctgctgacgcgccaaatcgaaggggcgcaacgcaaagtcgaaggcagaaacttcgatatgcgcaaacaggttttggaatacgacgacgttgccaacgaacagcgcaaagtcatttacagccagcgcaacgaaattctgaccagcaaagacatcggcgacctgatgcaggaaatccgttctgatgccgtcagcggacctcgtggatacctatatgccgcccgacagcatggaagaacaatgggacatcccgacactggaaaaccgcctggctgccgaattcaggcttcaggaagacatccaatcctggctgaaggcggacaatgcgat

SEQ ID NO: 5888 - protein, 732 aa, Neisseria gonorrhoeae
MLTNIAKKIFGSRNDRLLKQYRKSVARINALEEQMQALSDADLQAKTAEFKQRLADGQTLDGILPEAFAVCREASRRVLGMRHFDVQLIGGMVLHDGKIAEMRTGEGKTLVATLAVYLNALAGKGVHVVTVNDYLASRDAGIMEPLYNFLGLTVGVIISDMQPFDRQNAYAADITYGTNNEFGFDYLRDNMVTDQYDKVQRELNFAVVDEVDSILIDEARTPLIISGQADDNIQLYQIMNTVPPHLVRQETEEGEGDYWVDEKAHQVILSETGHEHAEQILTQMGLLAENDSLYSAANISLMHHLMAALRAHSLFHKDQHYVIQDGEIVIVDEFTGRLMSGRRWSEGLHQAVEAKEGVEIKRENQTLASITFQNYFRLYTKLSGMTGTADTEAFEFQSIYNLETVIIPTNRPVQRKDLNDQIFRSAEEKFEAVVKDIEECHKRGQPVLVGTTSIENSELVSRLLQKAGLPHNVLNAKEHEREALIVAQAGKVGAITVATNMAGRGTDIVLGGNLKHQTDAIRADETLSDEEKQAQIAALENGWQAEHDKVMEAGGLHIIGTERHESRRIDNQLRGRSGRQGDPGSSRFYLSFEDPLLRLFALDRAAAILNRLAPERGVAIEHNLLTRQIEGAQRKVEGRNFDMRKQVLEYDDVANEQRKVIYSQRNEILTSKDIGDLMQEIRSDAVSGPRGYLYAARQHGRTMGHPDTGKPPGCRIQASGRHPILAEGGQCD

SEQ ID NO: 5889 - DNA, 699 bp, Neisseria gonorrhoeae
atgccgtcagcggacctcgtggatacctatatgccgcccgacagcatggaagaacaatgggacatcccgacactggaaaaccgcctggctgccgaattcaggcttcaggaagacatccaatcctggctgaaggcggacaatgcgattgacggtcaagacatcaaagagcgcctgatcgaacgtatcgaaaacgaatatgccgccaaaaccgaactggtcggcaagcaggcaatggctgatttcgagcgcaacgtgatgttgcaggccatcgacaaccaatggcgcgaacatcttgccgccatggactacctgcgacaaggcatacacctgcgcagctatgcccagaaaaatccgaagcaggaatataaacgcgaagcctttaccatgttccaagacctgtggaacggcatcaaattccatatcgcctccctgcttacttcggttcaaatcgaacaaaaccctgtcgcggcggttgaagagcaacccgtcggcaacatccagtccatccattccgaatcgcccgatatagaagaacttttgggtcagtcgcaaaccgatctggttaccgaagcctttaatcccgatgggacggatttcagccccgaagccttggaagcgcggggacaaatcgtccaccgcaacgacccctgcccctgcggcagcggtttgaaatacaaacaatgccacggcaaattggct

SEQ ID NO: 5890 - protein, 233 aa, Neisseria gonorrhoeae
MPSADLVDTYMPPDSMEEQWDIPTLENRLAAEFRLQEDIQSWLKADNAIDGQDIKERLIERIENEYAAKTELVGKQAMADFERNVMLQAIDNQWREHLAAMDYLRQGIHLRSYAQKNPKQEYKREAFTMFQDLWNGIKFHIASLLTSVQIEQNPVAAVEEQPVGNIQSIHSESPDIEELLGQSQTDLVTEAFNPDGTDFSPEALEARGQIVHRNDPCPCGSGLKYKQCHGKLA

SEQ ID NO: 5891 - DNA, 1860 bp, Neisseria gonorrhoeae
ttgcctgaaccgccacatccgaccgccattccgaaaaatcccgatttcgtaccgtccgtaccgaaaacagacatcccgtccccccacatcatgattccatccgacttcattgacgagcttctggccaaaaccgatattgtcggcatcatcgacgagcaggttccgctgaaaaaaggcggggcgaactatatggcgtgttgcccgttccacaaggaaaaaacaccgtcgttttcggtcagtccgaccaagcagttttatcattgtttcagttgcggggcgcatggttcggcgattggttttgtgatggaacatcagggactgtcgtttccggaggcggttcagttccttgccgaccgcgtaggtatgattgtgcctaaagtgcgcgggcagaacgataatcccgaagtccgtgccgagcgcaagaaaaaacagcagacgctggaagaaacgacggcggcggcagctgatttttacgcgcagcagctgaaattcaatccggctgcgaaagcttatttggacaaacgcggcttgagcgcggaagtcatcgcgcattatggtttgggctacgcgcccgacggctggcagcctttggcgcaagtgttccaaccgtatccgaataccgcgttggtggatacggggatggtgattgacaatgaggggcggcattacgaccgcttccgccatcggattatgttccccatccgcaatccgcgcgggcaggtcatcggtttcggcggcagggtgctggacgactcgaaaccgaaatatttgaattcgcccgatacgcctttgttcgataaggggaaaaacctttacggcttgtatgaggggcgtgctgctgtaaaagaggcagaacggattttggtggtcgaaggctatatggacgtggtcgcgctggcacagttcggcgtgggctacggtgtggcggccttgggcacggcgacgacggcggaacacgtcaaaatcctgatgcggcaggcggacagtatttatttctgtttcgacggcgacagcgcggggcgaaaagcggcttggcgcgcgctggaaaacgcgctgccgcagttgaaagacgacaaatcgctgcattttttattcctgccggaagaacacgaccccgacagctacatccgcgcctacggcaaagcgcaatttgaagacgcgcttctgaatcaaagcaagcctttgtcggaatatttctgggaacacctttcagacggcattcatctcaatacgcaggaaggcaaggcggaattggtgaaaaccagttcgccgcttttggtgcagattaccgcaccggcattggcttatttgttaaaacaacggcttagcgagctggtcggcatcgaccccgacaacctcgcgcaactgctcggacaggaagcgccaaagcggcacgtcaaacaaaaaaactacaaactgcctccgatttccgtcaaacagcccgttatgccgacattggtgcaacggcaaatccgcagcctcttgataaatccggattgggctgcatatatagacctgcccgattatctggcgttggacggcgatttcgcctgccttgccaacctcgccgaaaccattaaaaaccatccttccgtgccggcaaccgcacaggttttggaacatatgcgcggttcgccctacgaagaaacaatcaaccgcatcttccggtcggcccttcaatcggaagaaatggaaggcggcggcgaagaagattgcgaaaacttccaaatcggcatcaaaaaactgctcaatgagttaaaatacagccaaattgaaacattaaaacaaaaaagcctgcaatccggcttaaatgaaagcgagaaaaaacttttgctgtcgctgctgaccgcaaaacaaaat

SEQ ID NO: 5892 - protein, 620 aa, Neisseria gonorrhoeae
LPEPPHPTAIPKNPDFVPSVPKTDIPSPHIMIPSDFIDELLAKTDIVGIIDEQVPLKKGGANYMACCPFHKEKTPSFSVSPTKQFYHCFSCGAHGSAIGFVMEHQGLSFPEAVQFLADRVGMIVPKVRGQNDNPEVRAERKKKQQTLEETTAAAADFYAQQLKFNPAAKAYLDKRGLSAEVIAHYGLGYAPDGWQPLAQVFQPYPNTALVDTGMVIDNEGRHYDRFRHRIMFPIRNPRGQVIGFGGRVLDDSKPKYLNSPDTPLFDKGKNLYGLYEGRAAVKEAERILVVEGYMDVVALAQFGVGYGVAALGTATTAEHVKILMRQADSIYFCFDGDSAGRKAAWRALENALPQLKDDKSLHFLFLPEEHDPDSYIRAYGKAQFEDALLNQSKPLSEYFWEHLSDGIHLNTQEGKAELVKTSSPLLVQITAPALAYLLKQRLSELVGIDPDNLAQLLGQEAPKRHVKQKNYKLPPISVKQPVMPTLVQRQIRSLLINPDWAAYIDLPDYLALDGDFACLANLAETIKNHPSVPATAQVLEHMRGSPYEETINRIFRSALQSEEMEGGGEEDCENFQIGIKKLLNELKYSQIETLKQKSLQSGLNESEKKLLLSLLTAKQN

SEQ ID NO: 5893 - DNA, 795 bp, Neisseria gonorrhoeae
atgctgaaacaacgggtaataaccgctatgtggctgctgccgctgatgctgggcatgctgttttacgcgccgcaatggctgtgggctgcattttgcgggctgattgccctgaccgccttgtgggagtatgcccgtatggccggtttgtgcaaaaccgaaaccaaccattacctcgccgcaaccttggttttcggcgtagttgcctatgcgggcggctggatgctgcctaatttggtttggtatgttgttttggcattttggctcgccgttatgcctttgtggttgagattcaaatggaggctcaacggcggttggcaggtttatgccgtcggctggcttttgctcatgccgttttggttcgcgctcgtatccctgcgcccgcatcccgatgatgccctgccgctgctcgccgtgatgggtttggtctgggttgccgacgtttgcgcgtatttcagcggcaaggcgctcggcaaacacaaaatcgcaccggcaatcagccccggcaagagctgggaaggcgcaatcggcggtgcggtttgcgtggcagtgtacatgactgccgtacgaagtgccggctggctggcattcgatacaggctggttcgataccgtgttaatcggtttggtgttgaccgttgtcagcgtatgcggcgacctgttggaaagctggctcaagcgcgcggcaggcatcaaagacagcagcaacctgctgcccggacacggcggcgtgttcgaccgtaccgacagcctgattgccgttatcagcgtctatgcggcgataatgtcggttttaaat

SEQ ID NO: 5894 - protein, 265 aa, Neisseria gonorrhoeae
MLKQRVITAMWLLPLMLGMLFYAPQWLWAAFCGLIALTALWEYARMAGLCKTETNHYLAATLVFGVVAYAGGWMLPNLVWYVVLAFWLAVMPLWLRFKWRLNGGWQVYAVGWLLLMPFWFALVSLRPHPDDALPLLAVMGLVWVADVCAYFSGKALGKHKIAPAISPGKSWEGAIGGAVCVAVYMTAVRSAGWLAFDTGWFDTVLIGLVLTVVSVCGDLLESWLKRAAGIKDSSNLLPGHGGVFDRTDSLIAVISVYAAIMSVLN

SEQ ID NO: 5895 - DNA, 783 bp, Neisseria gonorrhoeae
atgaaaaccaagttaatcaaaatcttgaccccctttaccgtcctgccgctgctggcttgcgggcaaacgcccgtttccaatgccaacgccgaatccgccgtcaaagccgaatccgccggcaaatccgttgccgcttctttgaaagcgcgtttggaaaaaacctattccgcccaagatttgaaagtgttgagcgtcagcgaaacaccggtcaaaggcatttacgaagtcgtcgtcagcggcaggcagattatctacaccgatgccgaaggcggctatatgttcgtcggcgaactcatcaacatcgacacgcgcaaaaacctgaccgaagaacgcgccgccgatttgaacaaaatcgacttcgcctccctgcctttggacaaagccatcaaagaagtacgcggcaacggcaagctgaaagtcgccgtcttctccgaccccgattgtccgttctgcaaacgcttggaacatgagtttgaaaaaatgaccgacgtgacggtttacagctttatgatgcccattgccggcctgcacccagatgccgcgcgcaaggcgcaaatcttatggtgtcagcccgaccgtgccaaagcgtggacggattggatgcgtaaaggcaaattcccggtcggcggcagcatctgcgacaatcccgtcgcggaaaccacttccttgggcgaacagttcggcttcaacggcacgccgaccctcgtcttccccaacgggcgcacccaaagcggttacagcccgatgccccaactggaggaaatcatccgcaaaaaccagcag

SEQ ID NO: 5896 - protein, 261 aa, Neisseria gonorrhoeae
MKTKLIKILTPFTVLPLLACGQTPVSNANAESAVKAESAGKSVAASLKARLEKTYSAQDLKVLSVSETPVKGIYEVVVSGRQIIYTDAEGGYMFVGELINIDTRKNLTEERAADLNKIDFASLPLDKAIKEVRGNGKLKVAVFSDPDCPFCKRLEHEFEKMTDVTVYSFMMPIAGLHPDAARKAQILWCQPDRAKAWTDWMRKGKFPVGGSICDNPVAETTSLGEQFGFNGTPTLVFPNGRTQSGYSPMPQLEEIIRKNQQ

SEQ ID NO: 5897 - DNA, 825 bp, Neisseria gonorrhoeae; identical to SEQ ID NO: 3547

SEQ ID NO: 5898 - protein, 275 aa, Neisseria gonorrhoeae; identical to SEQ ID NO: 3548

SEQ ID NO: 5899 - DNA, 1926 bp, Neisseria gonorrhoeae
atgtccaaaaaccaaaatcacgaagaataccaagacgatgcccgccccctgacgattgaggaacaacgtgcgcgcctgcgccaactcatcattatgggcaaagaacgcggctacatcacctactccgaaatcaacgacgcactgcccgacgatatgtccgatgccgatcaaatcgacaacatcgtcagtatgatttccggtttgggtatccaagttaccgaacacgcccctgatgcggaagacatattgttaagcgacaatgccgccgttaccgacgatgatgccgtcgaagaagccgaggccgccctttccagcgcagattccgagttcggcaggacgaccgaccccgtccgtatgtatatgcgcgaaatgggacaggtcgacctgctgacccgcgaagacgaaatcatcatcgccaaaaaaatcgaaaacgccctgaaaaatatggttcaggccatctccgcctgcccgggttccattgcggaaatcttagaactcatcgaaaaaatctgcaaagacgaaatccgcgtcgacgaagtcgtagaagccattatcgacccgaatgaagtattgctcaacgaattgggcttggggcacttggaaaccacagcacccgagaaaccttccaacgacaattcggacgaaaacgaagacgacgaagaatcggaagaagatgcggatgaaatctcggcagccaatctcgccgaattgaaacaaaaagtcatcggccactttgcccaaatcgaaaaagactacaaaaaaatgatcggctgtttggaaaaacaccacagccggcacaaagactatctcgcctaccgcgacgcgattgccaacaaactgctggaagtccgtttcgccacccggcaaatcgacagcctcagcagcagcctgcgcggaaaagtagaaaacatccgcaaactcgaacgcgaaatccgcgacatctgcctcgaccgcgtccatatggaacgcgactacttcatccaaaacttcctgcccgaaatcaccaatctgcaatggattgaagaagaaatcgccaaaggcagggtttggagcaacgcactcgaccgcttccgccacgccatcctcgaaaaacaaaccgagttggcggatatggaaaaagaaacccgcatttccatcgaagagttgaaagaaatcaacaaaaatatggtgtcgagcgaaaaagaaaccgcagccgccaaacaggaaatgattcaggcaaacttgcgcctcgtcatttccattgccaaaaaatacaccaaccgtggcttgcagttccttgatttgattcaggaaggcaacatcggcctgatgaaggcggtcgacaagttcgaataccgccggggctacaaattctccacctacgcaacctggtggatccgccaggcaattacccgctcgattgccgatcaggcgcgtaccatccgtattccggtacatatgattgaaaccatcaacaagatgaaccgcatctcgcgccaacaccttcaagaaaccggcgaagaacccgattccgccaaacttgccgaactgatgcagatgcccgaagacaaaatccgcaaaatcatgaaaatcgccaaagagccgatttcgatggaaacccccatcggcgacgacgacgattcgcacttgggcgacttcatcgaagatgccaacaatgttgcgccggccgatgcggcaatgtacaccagcctgcacgaagtaaccaaagaaatcctcgaaagcctgacaccgcgtgaggcaaaagtcctgcgtatgcgtttcggcatcgatatgaacaccgaccacacgctggaagaagtcggcagacagtttgacgtaacgcgcgaacgcatccgtcaaatcgaggcaaaagcactccgcaagctgcggcatccgacaagaagcgaccgtttgagaagtttcttggacagcgaagacagcaagctg

SEQ ID NO: 5900 - protein, 642 aa, Neisseria gonorrhoeae
MSKNQNHEEYQDDARPLTIEEQRARLRQLIIMGKERGYITYSEINDALPDDMSDADQIDNIVSMISGLGIQVTEHAPDAEDILLSDNAAVTDDDAVEEAEAALSSADSEFGRTTDPVRMYMREMGQVDLLTREDEIIIAKKIENALKNMVQAISACPGSIAEILELIEKICKDEIRVDEVVEAIIDPNEVLLNELGLGHLETTAPEKPSNDNSDENEDDEESEEDADEISAANLAELKQKVIGHFAQIEKDYKKMIGCLEKHHSRHKDYLAYRDAIANKLLEVRFATRQIDSLSSSLRGKVENIRKLEREIRDICLDRVHMERDYFIQNFLPEITNLQWIEEEIAKGRVWSNALDRFRHAILEKQTELADMEKETRISIEELKEINKNMVSSEKETAAAKQEMIQANLRLVISIAKKYTNRGLQFLDLIQEGNIGLMKAVDKFEYRRGYKFSTYATWWIRQAITRSIADQARTIRIPVHMIETINKMNRISRQHLQETGEEPDSAKLAELMQMPEDKIRKIMKIAKEPISMETPIGDDDDSHLGDFIEDANNVAPADAAMYTSLHEVTKEILESLTPREAKVLRMRFGIDMNTDHTLEEVGRQFDVTRERIRQIEAKALRKLRHPTRSDRLRSFLDSEDSKL

SEQ ID NO: 5901 - DNA, 249 bp, Neisseria gonorrhoeae
ttgaaaattttttggcgcatttttatgcgtcaaatttcgttaacagactatttttgcaaaggtctcggcctacgcgcccaaaccctcgcaactatagccgccgtccgcgaactcttaaacagcggacaaaccccgccgcccgactacggcaaacgctgcaaagcctgctctctggtggaaatctgtcagccggagttgttggcgaaacgggatgggagtgtgggatatgtggaagcgttgtttattgtg

SEQ ID NO: 5902 - protein, 83 aa, Neisseria gonorrhoeae
LKIFWRIFMRQISLTDYFCKGLGLRAQTLATIAAVRELLNSGQTPPPDYGKRCKACSLVEICQPELLAKRDGSVGYVEALFIV

SEQ ID NO: 5903 - DNA, 483 bp, Neisseria gonorrhoeae; identical to SEQ ID NO: 291

SEQ ID NO: 5904 - protein, 161 aa, Neisseria gonorrhoeae; identical to SEQ ID NO: 292

SEQ ID NO: 5905 - DNA, 366 bp, Neisseria gonorrhoeae
atgaaatattggctagttggagcctcttggggagggcaggggcatcaagatcaattttttgttgaaaatggttactgggttttggagtgggaatcctctcaacaaccagatcaatttgcaaaaggagaaaaaatccaagtaggtgatcgaattgcaatcaaacgcatgaaaggtcaaggatcgtctgaaattaagattttacatattggaatcgttaagggggttatttctgaaacgaacaaaattatctgtgtcgttgattggatagttaaaaatttagatagaaatgttgaaagtagaggatgctttaaaagtattcatgatccatatgataaagatgaatggatagaaaaaattttttgtttg

SEQ ID NO: 5906 - protein, 122 aa, Neisseria gonorrhoeae
MKYWLVGASWGGQGHQDQFFVENGYWVLEWESSQQPDQFAKGEKIQVGDRIAIKRMKGQGSSEIKILHIGIVKGVISETNKIICVVDWIVKNLDRNVESRGCFKSIHDPYDKDEWIEKIFCL

SEQ ID NO: 5907 - DNA, 501 bp, Neisseria gonorrhoeae
gtgatgaccaccgaagtcaacagcggacaagtgcgcggcccggtgcaactggcgtttgcccaatccatcgatccgattgtgccgccggaagtttccatcacacgcatggcggtaaccaatgaaaaagacttggaaaaagaacgcaccatggggcgcaaatacatcgtcccttacgtggtctaccgcgtgcatggctttatctccgccaaccttgccgccaaaaccggtttttcagacgacgacttagccaaactctggcaagccctgacgttgatgtttgaacacgaccgctcagccgcccgtggagaaatggcggcacgcaaactggttgttttcaaacacgacagcgcacttggcagccagcctgcacataaactgtttgacgccgtgaaagtcgaacgcgtaaacggcgaatcaggtacgcccgcaagcggttttggcgattacaaaatcagcgtggtttcagacgggctaaatggcgtgagtgtggaagagtatttg

SEQ ID NO: 5908 - protein, 167 aa, Neisseria gonorrhoeae
VMTTEVNSGQVRGPVQLAFAQSIDPIVPPEVSITRMAVTNEKDLEKERTMGRKYIVPYVVYRVHGFISANLAAKTGFSDDDLAKLWQALTLMFEHDRSAARGEMAARKLVVFKHDSALGSQPAHKLFDAVKVERVNGESGTPASGFGDYKISVVSDGLNGVSVEEYL

SEQ ID NO: 5909 - DNA, 120 bp, Neisseria gonorrhoeae
atgaaaaaggcttggaaccatgttccaagcctttttcaaatgccgtctgaagcctgtcgcggcagcttcagacggcatctttgttcaaacctcaatcctgcgccaatgcatctatcggat

SEQ ID NO: 5910 - protein, 40 aa, Neisseria gonorrhoeae
MKKAWNHVPSLFQMPSEACRGSFRRHLCSNLNPAPMHLSD

SEQ ID NO: 5911 - DNA, 531 bp, Neisseria gonorrhoeae
ttgccgaccatggccgttgcgtcaaatgtcagcttggatatgtccaatcctacggtgttacgcatgggattacccttatatattgcgtccctaagaaggggcgcaatatataaggtgtggcaatttgtcgaagacgcgctgcgtgccgtcgtgcctgccgacagttttgaaccgaccgcgcaaaaattgaagctgtttaaggcgggcgcggcaaccattttgttttatgaagatcaaaatgtcgtcaaaggtttgcaggagcagttccctgcttatgccgccaactttcccgtttgggcggaccaggcgaacgctatggtacagtatgccgtctggacgacacttgccgcggtcggtgcaggtgcaaatctgcaacattacaaccccttgcccgatgtggcgattgctaaagcgtggaatattcccgaaaactggctgttgcgcgcgcaaatggttatcggtggtattgaaggggcggcaggtgaaaaggtctttgaacccgttgcggaacgtttgaaagtgttcggcgca

SEQ ID NO: 5912 - protein, 177 aa, Neisseria gonorrhoeae
LPTMAVASNVSLDMSNPTVLRMGLPLYIASLRRGAIYKVWQFVEDALRAVVPADSFEPTAQKLKLFKAGAATILFYEDQNVVKGLQEQFPAYAANFPVWADQANAMVQYAVWTTLAAVGAGANLQHYNPLPDVAIAKAWNIPENWLLRAQMVIGGIEGAAGEKVFEPVAERLKVFGA

SEQ ID NO: 5913 - DNA, 333 bp, Neisseria gonorrhoeae
ttgagccttgtgcgtggaaaacgccgccgtctatttggcggctcttgttgcaaactgccgtgctgggcaaaagcgaaaacatccaaaggcttggtaaccgatgtctgcctgaaacgcaaaatccgtaattttgtcgaaatcagcagcgaaaacgaagccggttacgaaatctacgtcaaagaaaaaagcgtgctgaacctgcaaaacaaacgcgcttatgaagcactcggcattgagtctgaagccaaaaactgccgaaggacgaagccaaagcccgtgacattaccgcgtggatgtgtaaaaacttcttcgatatccgaaccttcggcgccg

SEQ ID NO: 5914 - protein, 111 aa, Neisseria gonorrhoeae
LSLVRGKRRRLFGGSCCKLPCWAKAKTSKGLVTDVCLKRKIRNFVEISSENEAGYEIYVKEKSVLNLQNKRAYEALGIESEAKNCRRTKPKPVTLPRGCVKTSSISEPSAP

SEQ ID NO: 5915 - DNA, 357 bp, Neisseria gonorrhoeae
gtgtttacgccgtcggatgacgaacaagaaagcgccaaaattttcaacgtattggaacaaatcggcaaaggtcgtccgctgcaagaaattgcgcctgaactctctcccaatacccgtttttacatcttggggcttgcccccaatgctgcgcggatttctgttcggttttggctggacaccacatttgggcagctggcggaaaacttggcgcatcattggcaagatttagcccttgagccttgtgcgtggaaaacgccgccgtctatttggcggctcttgttgcaaactgccgtgctgggcaaaagcgaaaacatccaaaggcttggtaaccgatgtctgcctgaaacgcaaaatccg

SEQ ID NO: 5916 - protein, 119 aa, Neisseria gonorrhoeae
VFTPSDDEQESAKIFNVLEQIGKGRPLQEIAPELSPNTRFYILGLAPNAARISVRFWLDTTFGQLAENLAHHWQDLALEPCAWKTPPSIWRLLLQTAVLGKSENIQRLGNRCLPETQNP

SEQ ID NO: 5917 - DNA, 864 bp, Neisseria gonorrhoeae; identical to SEQ ID NO: 81

SEQ ID NO: 5918 - protein, 288 aa, Neisseria gonorrhoeae; identical to SEQ ID NO: 82

SEQ ID NO: 5919 - DNA, 120 bp, Neisseria gonorrhoeae
ttgggctggatgctgcacgatattgattttgatcacggcaacacgccgcattttttccgcacgcaaatgaaagacggcttgattgatgtgccgccgttttacgccgaggaggtgaaagca

SEQ ID NO: 5920 - protein, 40 aa, Neisseria gonorrhoeae
LGWMLHDIDFDHGNTPHFFRTQMKDGLIDVPPFYAEEVKA

SEQ ID NO: 5921 - DNA, 348 bp, Neisseria gonorrhoeae
ttgtacggcagccgccgtttgccatgcgcccaaacagatgcggatggcgcgcaaaaaaagaccgccgcttacaaaggacaagacccggccaaagtaacgcattatttgacacggccggccggattttccgactgccaacgcgtttgtccggatgaaacaggattcgaccgccgcctgttccgcccctatgcccgcagcctgaaagggcaaatggcgaaagcgcggataagggtgaaccgctgccgccgtcggcgttatcggaaagcgaggcaaaccgcgatttgggctggatgctgcacgatattgattttgatcacggcaacacgccgcattttttccgcacgcaaa

SEQ ID NO: 5922 - protein, 116 aa, Neisseria gonorrhoeae
LYGSRRLPCAQTDADGAQKKTAAYKGQDPAKVTHYLTRPAGFSDCQRVCPDETGFDRRLFRPYARSLKGQMAKARIRVNRCRRRRYRKARQTAIWAGCCTILILITATRRIFSARK

SEQ ID NO: 5923 - DNA, 504 bp, Neisseria gonorrhoeae
atgctttcacctcctcggcgtaaaacggcggcacatcaatcaagccgtctttcatttgcgtgcggaaaaaatgcggcgtgttgccgtgatcaaaatcaatatcgtgcagcatccagcccaaatcgcggtttgcctcgctttccgataacgccgacggcggcagcggttcacccttatccgcgctttcgccatttgccctttcaggctgcgggcataggggcggaacaggcggcggtcgaatcctgtttcatccggacaaacgcgttggcagtcggaaaatccggccggccgtgtcaaataatgcgttactttggccgggtcttgtcctttgtaagcggcggtctttttttgcgcgccatccgcatctgtttgggcgcatggcaaacggcggctgccgtacaatcaaaatgtttggcgatttcatgcagacaggcatccggatgccgcccgacatatcgagccggtttttgcctatccgatttggcggcatttaggccggtaact

SEQ ID NO: 5924 - protein, 168 aa, Neisseria gonorrhoeae
MLSPPRRKTAAHQSSRLSFACGKNAACCRDQNQYRAASSPNRGLPRFPITPTAAAVHPYPRFRHLPFQAAGIGAEQAAVESCFIRTNALAVGKSGRPCQIMRYFGRVLSFVSGGLFLRAIRICLGAWQTAAAVQSKCLAISCRQASGCRPTYRAGFCLSDLAAFRPVT

SEQ ID NO: 5925 - DNA, 294 bp, Neisseria gonorrhoeae; identical to SEQ ID NO: 959

SEQ ID NO: 5926 - protein, 98 aa, Neisseria gonorrhoeae; identical to SEQ ID NO: 960

SEQ ID NO: 5927 - DNA, 1233 bp, Neisseria gonorrhoeae
atgccgtctgaaaacgcttcagacggcatccggtataaagttatcctcattatgacaccacaagtcctgaccatattaggcagtaccggcagcataggcgaaagcacgctggacgttgtctcccgccatcccgaaaaattccgcgtattcgcgctggcagggcataagcaggtcgagaaactggcggctcaatgtcaaacgttccgccccgaatatgccgtcgttgccgatgccgaacacgccgcccggcttgaagccctgttgaaacgcgacggcacggcgactcaggttttacacggcgcgcaggcattggttgacgttgcgtctgccgacgaagtcagcggcgtcatgtgcgccatcgtcggggcggcggggctgccttccgcgctcgcagcggcgcaaaaaggcaaaaccatttatctggcaaacaaagaaacgctggtggtttccggcgcgttgtttatggaaaccgcccgcgcaaacggcgcggcagtgttgcccgtcgacagcgaacacaacgccattttccaagttttgccgcgcgattacacagaccgtctgaacgaacacggcatcgattcgattatcctgaccgcttccggcggcccgtttttaacaaccgatttaagcacgttcgacagcattacgcccgagcaggcggtcaaacaccccaattggcgtatggggcgcaaaatctccgtcgattcagccactatggcaaacaagggcttggaactgattgaagcgcattggctgttcaactgtccgcccgacaaactcgaagtcgtcatccatccccaatccgtgatacacagtatggtgcgctaccgcgacggctccgtgctggcgcaactgggcaatcccgatatgcgaacgcccatcgcctattgtttgggcttgcccgagcgcatcgattcgggtgtcggcaaactcgatttcggcgcattgtccgcgctgaccttccaaaagcccgacttcggccgcttcccctgcctgaagttcgcctatgaaaccataaacgcaggcggagccgcgccctgcgtattgaacgccgccaacgaaaccgccgtcgccgcctttttggacggacagattaagtttaccgacattgccaaaaccgtcgcccactgtcttgcacaagacttttcaaacggcatgggcgatatagaaggactgttggcgcaagatgcccggacacgcgcacaagcgcgggcatttatcggcacactgcgc

SEQ ID NO: 5928 - protein, 411 aa, Neisseria gonorrhoeae
MPSENASDGIRYKVILIMTPQVLTILGSTGSIGESTLDVVSRHPEKFRVFALAGHKQVEKLAAQCQTFRPEYAVVADAEHAARLEALLKRDGTATQVLHGAQALVDVASADEVSGVMCAIVGAAGLPSALAAAQKGKTIYLANKETLVVSGALFMETARANGAAVLPVDSEHNAIFQVLPRDYTDRLNEHGIDSIILTASGGPFLTTDLSTFDSITPEQAVKHPNWRMGRKISVDSATMANKGLELIEAHWLFNCPPDKLEVVIHPQSVIHSMVRYRDGSVLAQLGNPDMRTPIAYCLGLPERIDSGVGKLDFGALSALTFQKPDFGRFPCLKFAYETINAGGAAPCVLNAANETAVAAFLDGQIKFTDIAKTVAHCLAQDFSNGMGDIEGLLAQDARTRAQARAFIGTLR

SEQ ID NO: 5929 - DNA, 942 bp, Neisseria gonorrhoeae; identical to SEQ ID NO: 1673

SEQ ID NO: 5930 - protein, 314 aa, Neisseria gonorrhoeae; identical to SEQ ID NO: 1674

SEQ ID NO: 5931 - DNA, 207 bp, Neisseria gonorrhoeae
atgactgattttgccgaccgcgcatccgaacgcgaagccgaatttctggtggaagccttggcgaaacaccaaccgccgtctgaaaacaccgccggcttcagccattgcgaagactgcggcgacccgataccggaagcaaagcgaaaagccgtccgaggctgtacgcgctgtgttgtctgccacgaatatattcaattaaaaacaaaa

SEQ ID NO: 5932 - protein, 69 aa, Neisseria gonorrhoeae
MTDFADRASEREAEFLVEALAKHQPPSENTAGFSHCEDCGDPIPEAKRKAVRGCTRCVVCHEYIQLKTK

SEQ ID NO: 5933 - DNA, 297 bp, Neisseria gonorrhoeae
atggctgaagccggcggtgttttcagacggcggttggtgtttcgccaaggcttccaccagaaattcggcttcgcgttcggatgcgcggtcggcaaaatcagtcatgtttcagacggcctttcgtgtgccagttctgccagccctcaatttggatttcgagctttcggtagtatccgccatagcggacggcgtggtttaaaagttgttcgggagagccgccggccggacgctcggggcgttcgtattcgaccagcagtccggaaggaacgggcggaatttccgcgacggcaacggttt

SEQ ID NO: 5934 - protein, 99 aa, Neisseria gonorrhoeae
MAEAGGVFRRRLVFRQGFHQKFGFAFGCAVGKISHVSDGLSCASSASPQFGFRAFGSIRHSGRRGLKVVRESRRPDARGVRIRPAVRKERAEFPRRQRF

SEQ ID NO: 5935 - DNA, 288 bp, Neisseria gonorrhoeae
gtgaagcggcagacaaagacggcaaccgttttaacggccttggcacgaacagcctgcacctctacaaccgtgccttcggataccccgattaaaaccgttgccgtcgcggaaattccgcccgttccttccggactgctggtcgaatacgaacgccccgagcgtccggccggcggctctcccgaacaacttttaaaccacgccgtccgctatggcggatactaccgaaagctcgaaatccaaattgagggctggcagaactggcacacgaaaggccgtctgaaacatgac

SEQ ID NO: 5936 - protein, 96 aa, Neisseria gonorrhoeae
VKRQTKTATVLTALARTACTSTTVPSDTPIKTVAVAEIPPVPSGLLVEYERPERPAGGSPEQLLNHAVRYGGYYRKLEIQIEGWQNWHTKGRLKHD

SEQ ID NO: 5937 - DNA, 285 bp, Neisseria gonorrhoeae
atgattgaatttgtccgagccaaaaaacggctgctttgggcatttgtacttttgcttgcgtgggcgtgcggctaccggtacgctgccgacaaggtcgaagcggaacaaaccgccctgattgccgcctatcggcattcttctatggttgcggcggaacaatacgccttgcagcttaaaaaagcgcaggacgaaaggcagcggtggtacgacttttcccaaaaacaaagcacggatttggcggccgccctgagcgaattggacaaaacgcgcaacaccttacaggag

SEQ ID NO: 5938 - protein, 95 aa, Neisseria gonorrhoeae
MIEFVRAKKRLLWAFVLLLAWACGYRYAADKVEAEQTALIAAYRHSSMVAAEQYALQLKKAQDERQRWYDFSQKQSTDLAAALSELDKTRNTLQE

SEQ ID NO: 5939 - DNA, 96 bp, Neisseria gonorrhoeae
ttggctcggacaaattcaatcattgccgcccccttcctgatttgcggattttttgatttccgccagctgcggaactgccgctatgccgcgtttgat

SEQ ID NO: 5940 - protein, 32 aa, Neisseria gonorrhoeae
LARTNSIIAAPFLICGFFDFRQLRNCRYAAFD

SEQ ID NO: 5941 - DNA, 537 bp, Neisseria gonorrhoeae
gtgcgttctttactccaacatgcttatgcagagctggttcatgacaatatatacaagcctgacggcaatgttccaaagcaagcagagcgcgaagtcgcgaagagcatggctttgatggaaactacagatgacttatttagtcgtactctggcaattttgaaagaagcaaatcaaccacaagaagaacttcttccccaattatcacagctttatcaaaaggaaatagggcttgttcctgaagttgataaaaaaaccaatatgatttttctagaaacatttcaatccagcatttcccaatcaagtattctttctgacatccgttcacttttgaatgagaagaaatatattgccaagcggataaaagaaaatgctgaagaaatgtattttttcagtcagccagcagctttgttggtctattggctgattgagaaagttggtgcagatgaagtatggaaaaaatggcctttgcctgcatacaacaaaaacctgaaattcatttgtactgatttggataagcaaccatcccatgaactcttt

SEQ ID NO: 5942 - protein, 179 aa, Neisseria gonorrhoeae
VRSLLQHAYAELVHDNIYKPDGNVPKQAEREVAKSMALMETTDDLFSRTLAILKEANQPQEELLPQLSQLYQKEIGLVPEVDKKTNMIFLETFQSSISQSSILSDIRSLLNEKKYIAKRIKENAEEMYFFSQPAALLVYWLIEKVGADEVWKKWPLPAYNKNLKFICTDLDKQPSHELF

SEQ ID NO: 5943 - DNA, 372 bp, Neisseria gonorrhoeae; identical to SEQ ID NO: 293

SEQ ID NO: 5944 - protein, 124 aa, Neisseria gonorrhoeae; identical to SEQ ID NO: 294

SEQ ID NO: 5945 - DNA, 1038 bp, Neisseria gonorrhoeae
ttgaaaaaaattattacccatcgtatttatccgaaaaatgaaaatagagagcgtgtagaacctaaaatcagtacacatttgattgatttgcctattacggcaagaagaacattggaaaccaggctgaccaaagctttgggtaataaatctcatggcattgaaatgtctgttgtcaatacggctgaaaatagtttttttcagatagcggcagccatacaactcaaagaggaagcagagtttattgaggattccgcacaatttgcccacatgttgaccgatgcacaactgaatacaaatgcaccgggtggtattttgttggttttaaaaggtagggttggagataccggtaagccgtttttatgtgtaattaaggctgaacctcaagatgggttccgaaccaaagaagaggatgactttatcacgattgaattcttagaagaattattactgaccgattcagcaagattattcaagataggttttttggtggctgaaacagtaaggccgctagagcaaatacaatctgggaattatcgagcttttttgtatgaccatctgatgacacaaacggaaactagaccggcagcttcctatttctatcaagtattcttgggtatgagtatagctgcttcttcccgtaaattgacgcaggatttttttgagtggacacgcaattttatcgataactctgatttaagtgatgatgcaaaattagatgcgcatgaagcattgcgcgttacattgaaaagtgcggaagcaaccattagtgtaaataattttgcccaaaatcatttacctcaagaaaaacgaacagcttatacagaatttatggtggaaaaggattttcctcaaaatgccgtaagtaaagatattgaatatattaaaactcgtttacgcaaacggaggtcttacggatttagtaacggtgtagttatcttgactcctcccgagcatactcaggactatatggaaattgcgccaacggaagatggggaatatactgttgtcctaattaaaggacagttacaacaacaaaaa

SEQ ID NO: 5946 - protein, 346 aa, Neisseria gonorrhoeae
LKKIITHRIYPKNENRERVEPKISTHLIDLPITARRTLETRLTKALGNKSHGIEMSVVNTAENSFFQIAAAIQLKEEAEFIEDSAQFAHMLTDAQLNTNAPGGILLVLKGRVGDTGKPFLCVIKAEPQDGFRTKEEDDFITIEFLEELLLTDSARLFKIGFLVAETVRPLEQIQSGNYRAFLYDHLMTQTETRPAASYFYQVFLGMSIAASSRKLTQDFFEWTRNFIDNSDLSDDAKLDAHEALRVTLKSAEATISVNNFAQNHLPQEKRTAYTEFMVEKDFPQNAVSKDIEYIKTRLRKRRSYGFSNGVVILTPPEHTQDYMEIAPTEDGEYTVVLIKGQLQQQK

SEQ ID NO: 5947 - DNA, 378 bp, Neisseria gonorrhoeae
gtggaaaaaacttctctttttggtaagcgattgaaagaagaaagaattaaattaggcttgaaccaagcagaagctgctgaaaaatgtggtttttctcgtgagatgtggggaaagtgggagcgtggtgaaaatcgcccatcaagtgaaaaattattctctttttctaaaatcggcatcgatattgattacgtcatgcacggcagacgcggcgaaacagccgccatgccgtctgaatccttgagtgctgaagaaaaagaactgcttgccctgttccgtcagctcggcagcggcagccgcaaagagcttgctgactacgccgcctttaagctggtggtagagaaaaaagcccaaactgcgcttggtaaagtgagcaacgga

SEQ ID NO: 5948 - protein, 126 aa, Neisseria gonorrhoeae
VEKTSLFGKRLKEERIKLGLNQAEAAEKCGFSREMWGKWERGENRPSSEKLFSFSKIGIDIDYVMHGRRGETAAMPSESLSAEEKELLALFRQLGSGSRKELADYAAFKLVVEKKAQTALGKVSNG

SEQ ID NO: 5949 - DNA, 291 bp, Neisseria gonorrhoeae
atgtttatcgtgcaaagaggcctaaaactaaacacattataccacacgaaaggcataaataatattgaaaaacctttaaatttcaagcctattccctatctgcaaacgcgcggcagcacggccgtgtggtttaagcgcaacggcgtgtgcaagacgcaccgggcgaaacatttcaatttggagcgcaccgcggtggaacaccccttgcgcggcaagctgaaaggcaatttcggcaaaagccacgaagcggcggtaaaacttgggctgaaggaggatgcggatggcgacgag

SEQ ID NO: 5950 - protein, 97 aa, Neisseria gonorrhoeae
MFIVQRGLKLNTLYHTKGINNIEKPLNFKPIPYLQTRGSTAVWFKRNGVCKTHRAKHFNLERTAVEHPLRGKLKGNFGKSHEAAVKLGLKEDADGDE

SEQ ID NO: 5951 - DNA, 276 bp, Neisseria gonorrhoeae
atgccgattaccggatgcgcgtccatcgccaaaaacacccgcaacagccgctgcgcctttttactcgtcgccatccgcatcctccttcagcccaagttttaccgccgcttcgtggcttttgccgaaattgcctttcagcttgccgcgcaaggggtgttccaccgcggtgcgctccaaattgaaatgtttcgcccggtgcgtcttgcacacgccgttgcgcttaaaccacacggccgtgctgccgcgcgtttgcagatagggaataggcttgaaatt

SEQ ID NO: 5952 - protein, 92 aa, Neisseria gonorrhoeae
MPITGCASIAKNTRNSRCAFLLVAIRILLQPKFYRRFVAFAEIAFQLAAQGVFHRGALQIEMFRPVRLAHAVALKPHGRAAARLQIGNRLEI

SEQ ID NO: 5953 - DNA, 246 bp, Neisseria gonorrhoeae
gtgtttttggcgatggacgcgcatccggtaatcggcatcagcaataaggagctttcagacggcctggggctgacgccatcacaagtcagcagggatattgatgatttggttgcatcgggattggtcatcaagcttgaaaacggcaactacgcctacggcatcaaaaccctacaaatcgcagagcggttcagaaaacagcaagagcggctgaatgcgcgcttgcaagaattggaaaaccgaatttac

SEQ ID NO: 5954 - protein, 82 aa, Neisseria gonorrhoeae
VFLAMDAHPVIGISNKELSDGLGLTPSQVSRDIDDLVASGLVIKLENGNYAYGIKTLQIAERFRKQQERLNARLQELENRIY

SEQ ID NO: 5955 - DNA, 180 bp, Neisseria gonorrhoeae
atggcaacagaaattttaggacatacggtcggcgtaacggcaaacgaattggctatccacagtatggaggttatggacaagttttcaggcggcgaggcctacaacgagacggtatggattgagcgcggacgatttgcggacgccaaacgatggaagggatgtttgagccgggacgcgcgc

SEQ ID NO: 5956 - protein, 60 aa, Neisseria gonorrhoeae
MATEILGHTVGVTANELAIHSMEVMDKFSGGEAYNETVWIERGRFADAKRWKGCLSRDAR

SEQ ID NO: 5957 - DNA, 1932 bp, Neisseria gonorrhoeae
atgagcttgatcgaatgtaaaaacatcaaccgctgcttcggcagcggcgagaaccgcgtccatattttgaaagacatcagcctgtcgatagagaagggtgattttgtcgccatcatcgggcagtccggttcgggcaagtccacgctgatgaacatactcggttgtttggataccgccggttccggttcgtaccgaatcgacggcatcgaaactgccaaaatgcagcctgacgaactggcggcattgcgccgcgaacgcttcggtttcatcttccaacgctacaacctcttaagctcgctgaccgcaagggacaacgtcgcgctgccagccgtgtatatgggtatgggcggcaaagagcgttccgcgcgggcggacaaactcttgcaggatttgggtttggcaagtaaagagggcaacaagcccggcgaactctcgggcggacagcagcagcgcgtctccatcgcccgcgccctgatgaacggcggagaaatcatcttcgccgacgagccgaccggcgcactcgataccgccagcggcaaaaatgtgatggaaatcatccgcaggctgcacgaagccgggcataccgtcattatggtcacgcacgaccccggcattgccgccaacgccaaccgcgtcatcgaaatccgggacggcgaaatcatttccgacacctcgaaaaatcccgaaatccccgcaagcaatgtcgggaggattcgggaaaaagcctcgtggtcgttttattacgaccagtttgtcgaagccttcagaatgtcggtgcaagcagtattggcgcacaaaatgcgttcgcttctgaccatgctcggcatcatcatcggtatcgcttcggttgtctccgtcgtcgcgctgggcaacggttcgcagaaaaaaatcctcgaagacatcagttcgatggggacgaacaccatcagcatcttccccgggcgcggcttcggcgacaggcgcagcggcaaaatcaaaaccctgaccatagacgacgcaaaaatcatcgccaaacaaagctacgttgcctccgccacgcccatgacttcgagcggcggcacgctgacctaccgcaataccgacctgaccgcttctttgtacggtgtgggcgaacaatatttcgacgtgcgcgggctgaagctggaaacggggcggctgtttgatgagaacgatgtgaaagaagacgcgcaagtcgtcgtcatcgaccaaaatgtcaaagacaaactctttgcggactcggatccgttgggtaaaaccattttgttcaggaaacgccccttgaccgtcatcggcgtgatgaaaaaagacgaaaacgctttcggcaattccgacgtgctgatgctttggtcgccctatacgacggtgatgcaccaaatcacaggcgagagccacaccaactccatcaccgtcaaaatcaaagacaatgccaatacccgggttgccgaaaaagggctggccgagctgctcaaagcacggcacggcacggaagacttctttatgaacaacagcgacagcatcaggcagatggtcgaaagcaccaccggtacgatgaagctgctgatttcctccatcgccctgatttcattggtagtcggcggcatcggtgtgatgaacattatgctggtgtccgttaccgagcgcaccaaagaaatcggcatacggatggcaatcggcgcgcggcgcggcaatattttgcagcagtttttgattgaggcggtgttaatctgcatcatcggaggcttggtcggcgtaggtttgtccgccgccgtcagcctcgtgttcaatcattttgtaaccgatttcccgatggacatttcggcggcatccgttatcggggcggtcgcctgttcgaccggaatcggcatcgcgttcggctttatgcctgccaataaggcagccaaactcaatccgatagatgcattggcgcaggat

SEQ ID NO: 5958 - protein, 644 aa, Neisseria gonorrhoeae
MSLIECKNINRCFGSGENRVHILKDISLSIEKGDFVAIIGQSGSGKSTLMNILGCLDTAGSGSYRIDGIETAKMQPDELAALRRERFGFIFQRYNLLSSLTARDNVALPAVYMGMGGKERSARADKLLQDLGLASKEGNKPGELSGGQQQRVSIARALMNGGEIIFADEPTGALDTASGKNVMEIIRRLHEAGHTVIMVTHDPGIAANANRVIEIRDGEIISDTSKNPEIPASNVGRIREKASWSFYYDQFVEAFRMSVQAVLAHKMRSLLTMLGIIIGIASVVSVVALGNGSQKKILEDISSMGTNTISIFPGRGFGDRRSGKIKTLTIDDAKIIAKQSYVASATPMTSSGGTLTYRNTDLTASLYGVGEQYFDVRGLKLETGRLFDENDVKEDAQVVVIDQNVKDKLFADSDPLGKTILFRKRPLTVIGVMKKDENAFGNSDVLMLWSPYTTVMHQITGESHTNSITVKIKDNANTRVAEKGLAELLKARHGTEDFFMNNSDSIRQMVESTTGTMKLLISSIALISLVVGGIGVMNIMLVSVTERTKEIGIRMAIGARRGNILQQFLIEAVLICIIGGLVGVGLSAAVSLVFNHFVTDFPMDISAASVIGAVACSTGIGIAFGFMPANKAAKLNPIDALAQD

SEQ ID NO: 5959 - DNA, 195 bp, Neisseria gonorrhoeae
atgagccgtcaatccctgcaacaggctgccgaaagccgccgttccgtttattcgttaaataaaaacctgcccgttggcaaagatgaaatcgtccaaatcgtcgaacacgccgttttgcacacacctttttcgttcaattcccaatctgcccgcgtggtcgtgctgtttggcgaagagcatgacgagatactactt

SEQ ID NO: 5960 - protein, 65 aa, Neisseria gonorrhoeae
MSRQSLQQAAESRRSVYSLNKNLPVGKDEIVQIVEHAVLHTPFSFNSQSARVVVLFGEEHDEILL

SEQ ID NO: 5961 - DNA, 111 bp, Neisseria gonorrhoeae
atgtttgagccgggacgcgcgctgatcatcatcaaagagcatacgccgcatgggcggtttgccgaaatcgctgaaaaagagttggcctcggacggcgggaatcccaaagac

SEQ ID NO: 5962 - protein, 37 aa, Neisseria gonorrhoeae
MFEPGRALIIIKEHTPHGRFAEIAEKELASDGGNPKD

SEQ ID NO: 5963 - DNA, 114 bp, Neisseria gonorrhoeae
atgggcggtttgccgaaatcgctgaaaaagagttggcctcggacggcgggaatcccaaagactgatgaatgccaccctccgttttatcgacccgaaaatgaaacaagcgcagcc

SEQ ID NO: 5964 - protein, 38 aa, Neisseria gonorrhoeae
MGGLPKSLKKSWPRTAGIPKTDECHPPFYRPENETSAA

SEQ ID NO: 5965 - DNA, 240 bp, Neisseria gonorrhoeae
ttggaagtcggtatccgctcgcaaatcagccgattgcgcgatatgttcgagcagatggcggcgcacggcgaggcgcatggatttgaccaccgcgcgaagatggtcggcacgctcaatcaaattattttggactgcgagcaactgcgcgaaagctatgccctaccgaccgaagcaccggcagacaatgtgccggaatggttgggcggtgaaacgggagaaggcgatgaatccggcaatgat

SEQ ID NO: 5966 - protein, 80 aa, Neisseria gonorrhoeae
LEVGIRSQISRLRDMFEQMAAHGEAHGFDHRAKMVGTLNQIILDCEQLRESYALPTEAPADNVPEWLGGETGEGDESGND

SEQ ID NO: 5967 - DNA, 2352 bp, Neisseria gonorrhoeae
atgaaacaagcgcagcctaagctgatgacgttgggcaaatccaaactgctcgagctgctggtcgaagacgacgacactttgttggagcttgccgaaggcggtgaggtcaacggcaacacttttgacgatgtcgaccgtatgactattaaggagctgcgcgtcgccctgcgcgaaagccgtgaaacggcggaagcgaaagataaggtgattgccgataaaaataaaaaggtcgatgagctggcggaaaagctgtcgaaaaagcagacgggtgtcaaagagcctaaacctgcggatgtgggcatcgagctgacgatgcagcttggcagcttgacagcttggaagtcggtatccgctcgcaaatcagccgattgcgcgatatgttcgagcagatggcggcgcacggcgaggcgcatggatttgaccaccgcgcgaagatggtcggcacgctcaatcaaattattttggactgcgagcaactgcgcgaaagctatgccctaccgaccgaagcaccggcagacaatgtgccggaatggttgggcggtgaaacgggagaaggcgatgaatccggcaatgattgagcgtcttaaagcagtcgaaaatcaggcggaagcaatggggcgcggcgcacgctctgcatatcttaagcagcaggcgcaggaattgggcatcagccttgccacgctataccgcaagctggaggcggtcagcgtcaagccgacgcgcaaacggcgcagcgatgcgggcaagacggagcttaaaccggaagaagccaaattgatttcggcggttttggcggaggcgatgaggcgcaacggcaagcggttgatgccggtgcggcaggcggtggaaatgctgcgcgccaacgggaaaatcgaggcggcgcggattgacggggaaaccggggaagtcatccccctttctgaaaacaccattacccgggctttacgggaatacaagctgcattccgaccagcttttgcagcccgaccccgtcagccgcatgaaatcggaacacccgaaccattgttggcaaatcgacccgagtttgtgcgttttgtattgcctgccgcgtcagggcaaggatacggggctgcgggtgatgaaggaagaggagttttataaaaacaagccgaaaaacgtcgtcaaaatcgaaaacgaccgcgtttggcggtacacggggacagaccatgcctccggcacgatttcggtgcgttattacttcggcggcgaaaccagcgcgaacctctgtgattttttcatctacatgatgcaggcgaaaaaagacatcggcaaagacccgttccggaccgtaccgcgcatggtcatgcttgacccgggcagcgcgaatacttcggcggcgtttaaaaatttgtgcaagcccttggatgtgcatgtgcaaatcaacaagccgggcaatccgcgtgccaaggggcaagtggaaaaagccaacgatattgtggaaacggcatttgagagcgggttgcgctttaccgaggtacacgacatcgaccagctcaatgctttatcggaacgctggatgcgttactacaacggtacgcaaaaacacagccgccacggcatgacccgctatcaggcgtggaacaaaatcaaacccgagcagctcatcctgccgccgcctgccgaatattgccgagagcttgccgtcagcgcgccgaaagaggcgaaagtctcggcggatttggaaatccgctttggcggacgggtatatagcgtaaaaggcatcaaggggattttggtcggtaagaaagttttggtcggtaagaaagttttggtcggtaagaatccttgggaggcaaacggggcgcgggtcgccacttatgacgcggagggtaacgaggtttgggtatccgtacccgaagtagtttttgacgagatgggcttcaaggctgatgccgcggtcatcggggcggaatacaaagccccggccgatacagacgcgcaacggcatcgcaaagagctggacaagctggcgatgggtgcggaaacgctggaggcggcagccgccaaacgcaaaggcaaggcagtcccgttcggcggcaaaatcgacccgtacaaacatcaagaagatacgcttgccgcaagcaatacgctctttatgcccaaacaggggcaacagatggattacaacaagatggaggtcgccgagcaggtattgagcaaggtcgaaatcgccaaacgcttaaaaccccgcgtcgaggcagacggcggcgactggaaacaggcagtgtcggtcatcctcaaacactacccggaaggtgtgaccgagggcaggctggaagaggcgtttgaacgcacccggacaagatgccgtctgaaacttttgaaaaccggt

SEQ ID NO: 5968 - protein, 784 aa, Neisseria gonorrhoeae
MKQAQPKLMTLGKSKLLELLVEDDDTLLELAEGGEVNGNTFDDVDRMTIKELRVALRESRETAEAKDKVIADKNKKVDELAEKLSKKQTGVKEPKPADVGIELTMQLGSLTAWKSVSARKSADCAICSSRWRRTARRMDLTTARRWSARSIKLFWTASNCAKAMPYRPKHRQTMCRNGWAVKREKAMNPAMIERLKAVENQAEAMGRGARSAYLKQQAQELGISLATLYRKLEAVSVKPTRKRRSDAGKTELKPEEAKLISAVLAEAMRRNGKRLMPVRQAVEMLRANGKIEAARIDGETGEVIPLSENTITRALREYKLHSDQLLQPDPVSRMKSEHPNHCWQIDPSLCVLYCLPRQGKDTGLRVMKEEEFYKNKPKNVVKIENDRVWRYTGTDHASGTISVRYYFGGETSANLCDFFIYMMQAKKDIGKDPFRTVPRMVMLDPGSANTSAAFKNLCKPLDVHVQINKPGNPRAKGQVEKANDIVETAFESGLRFTEVHDIDQLNALSERWMRYYNGTQKHSRHGMTRYQAWNKIKPEQLILPPPAEYCRELAVSAPKEAKVSADLEIRFGGRVYSVKGIKGILVGKKVLVGKKVLVGKNPWEANGARVATYDAEGNEVWVSVPEVVFDEMGFKADAAVIGAEYKAPADTDAQRHRKELDKLAMGAETLEAAAAKRKGKAVPFGGKIDPYKHQEDTLAASNTLFMPKQGQQMDYNKMEVAEQVLSKVEIAKRLKPRVEADGGDWKQAVSVILKHYPEGVTEGRLEEAFERTRTRCRLKLLKTG

SEQ ID NO: 5969 - DNA, 156 bp, Neisseria gonorrhoeae
ttgccgacgcggtttgcgtgccgtgtcggtttgcccgtccgtcccgaggcatcggacaagcagggtggtttttatagtggattaaatttaaaccggtacggcgttgcctcgccttgccgtactatttgtactgtctgcggcttcgccgccttgtcc

SEQ ID NO: 5970 - protein, 52 aa, Neisseria gonorrhoeae
LPTRFACRVGLPVRPEASDKQGGFYSGLNLNRYGVASPCRTICTVCGFAALS

SEQ ID NO: 5971 - DNA, 192 bp, Neisseria gonorrhoeae
atgcctcgggacggacgggcaaaccgacacggcacgcaaaccgcgtcggcaaaaatgccgtctgaaaaaattcagacggcatcttcagacacattacctgcaaacggcaacacattccaatccagaccgatcaggcaatcaatacgaacggctgtttacatacttaccagctttcaccaaccggtatcgatt

SEQ ID NO: 5972 - protein, 64 aa, Neisseria gonorrhoeae
MPRDGRANRHGTQTASAKMPSEKIQTASSDTLPANGNTFQSRPIRQSIRTAVYILTSFHQPVSI

SEQ ID NO: 5973 - DNA, 111 bp, Neisseria gonorrhoeae
atgggcggcgcattggaaatggatgacgggctttggtatttcgataaagatttaccggatgtgtttaaggcgaagtttaaaacggacaggaaaaatattaaggaaatcggt

SEQ ID NO: 5974 - protein, 37 aa, Neisseria gonorrhoeae
MGGALEMDDGLWYFDKDLPDVFKAKFKTDRKNIKEIG

SEQ ID NO: 5975 - DNA, 648 bp, Neisseria gonorrhoeae
ttgattggtgcaatacggaggaagtccgttttttttcccgcattgggcagcctgcatgcatataagattaaagcggaattggtcggacgttatcattcgggttgttatgtatctgccaaaaatctgcttaaaacatttacgaccgtcaggtttgaaaaaggttcagacggcatgttgaatgcgaaaacagcggctttgaaaaacggtgtgacggataatccgcctaccggattatttgccaataaaaaggcggcgagacgggctttgtcgtcgtgggcggaaacatacggattgtgtcctgcctcagccggtatccttccggacggttatgcagaggatgagccttgtcccgtatatgtttcaggccgatgcgataaggcgtgcggccgttctgacgaacaagttttggcgtttgcacacaagttgcctgttttggattggggaaaaatgcatgaggtggaaattaccgaaaccgatcctttaacgggggaaaagtcgttctgcatggaatgggcggcgcattggaaatggatgacgggctttggtatttcgataaagatttaccggatgtgtttaaggcgaagtttaaaacggacaggaaaaatattaaggaaatcggttaaatcgataccggttggtgaaagctgg

SEQ ID NO: 5976 - protein, 216 aa, Neisseria gonorrhoeae
LIGAIRRKSVFFPALGSLHAYKIKAELVGRYHSGCYVSAKNLLKTFTTVRFEKGSDGMLNAKTAALKNGVTDNPPTGLFANKKAARRALSSWAETYGLCPASAGILPDGYAEDEPCPVYVSGRCDKACGRSDEQVLAFAHKLPVLDWGKMHEVEITETDPLTGEKSFCMEWAAHWKWMTGFGISIKIYRMCLRRSLKRTGKILRKSVKSIPVGESW

SEQ ID NO: 5977 - DNA, 1422 bp, Neisseria gonorrhoeae
atgcccggacacgcgcacaagcgcgggcatttatcggcacactgcgctgataccgtccgaacaccgttatcaaaggaaaaccatttgcaaacccttctagcttttatcttcgccatcctgattttggtcagcctgcacgaattcggacactacatcgtcgccaggttgtgcggcgtcaaggttgtgcgtttttccgtcggcttcggcaaaccgtttttcacccgaaagcgcggcgacaccgaatggtgcctcgccccgattccgttgggcggctacgtcaaaatggtcgatacgcgcgaaggcgaagtatcagaagccgatttaccctacgcttttgacaaacaacaccccgccaagcgcatcgccatcgtcgccgccggtccgctgaccaacctcgcactggcggttttgctgtacggactgagcttttccttcggcgtaaccgaactgcggccctatgtcggcacagtcgaacccgacaccattgccgcccgcaccggcttccaaagcggcgacaaaatacaatccgtcaacggcgtttccgtccaagactggagcagcgcgcaaaccgaaatcgtcctcaacctcgaagccggcaaagtcgccgtcggcgttcagacggcatcgggcgcgcaaaccgtccgcaccatcgatgccgcaggcacgccggaagccggtaaaatcgcaaaaaaccaaggctacatcggactgatgccctttaaaatcacaaccgttgccggcggcgtggaaaaaggcagccccgccgaaaaagcaggcctgaaaccgggcgacaggctgactgccgccgacggcaaacccatcgcctcatggcaggaatgggcaaacctgacccgccaaagcccgggcaaaaaaatcaccctgacctacgaacgcgccggacaaacccataccgccgacatccgccccgatactgtcgaacagcccgaccacaccctgatcgggcgcgtcggcctccgtccgcagccggacagggcgtgggacgcgcaaatccgccgcagctaccgtccgtctgttgtccgcgcattcggcatgggctgggaaaaaaccgtttcccactcgtggacaaccctcaaatttttcggcaaactaatcagcggcaacgcctctgtcagccatatttccgggccgctgaccattgccgacattgccggacagtccgccgaactcggcttgcaaagttatttggaatttttagcgttggtcagcatcagcctcggcgtgctgaacctgctgcccgtccccgttttggacggcgggcacctcgtgttttatactgtcgaatggatacgcggcaaacctttgggcgaacgtgtccaaaacatcggtttgcgcttcgggctcgccctgatgatgctgatgatggcggccgccttcttcaacgacgttacccggctgatcggt

SEQ ID NO: 5978 - protein, 474 aa, Neisseria gonorrhoeae
MPGHAHKRGHLSAHCADTVRTPLSKENHLQTLLAFIFAILILVSLHEFGHYIVARLCGVKVVRFSVGFGKPFFTRKRGDTEWCLAPIPLGGYVKMVDTREGEVSEADLPYAFDKQHPAKRIAIVAAGPLTNLALAVLLYGLSFSFGVTELRPYVGTVEPDTIAARTGFQSGDKIQSVNGVSVQDWSSAQTEIVLNLEAGKVAVGVQTASGAQTVRTIDAAGTPEAGKIAKNQGYIGLMPFKITTVAGGVEKGSPAEKAGLKPGDRLTAADGKPIASWQEWANLTRQSPGKKITLTYERAGQTHTADIRPDTVEQPDHTLIGRVGLRPQPDRAWDAQIRRSYRPSVVRAFGMGWEKTVSHSWTTLKFFGKLISGNASVSHISGPLTIADIAGQSAELGLQSYLEFLALVSISLGVLNLLPVPVLDGGHLVFYTVEWIRGKPLGERVQNIGLRFGLALMMLMMAAAFFNDVTRLIG

SEQ ID NO: 5979 - DNA, 1176 bp, Neisseria gonorrhoeae
atggcaaaaatgatgaaatgggcggctgttgcggcggtcgcggcggcagcggtttggggcggatggtcttatctgaagcccgaaccgcaggctgcttatattacggaaacggtcaggcgcggcgatatcagccggacggtttccgcgacgggcgagatttcgccgtccaacctggtatcggtcggcgcgcaggcttcggggcagattaaaaagctttatgtcaaactcgggcaacaggtcaaaaagggcgatttgattgcggaaatcaattcgaccacgcagaccaacacgatcgatatggaaaaatccaaattggaaacgtatcaggcgaagctggtgtcggcacagattgcattgggcagcgcggagaagaaatataagcgtcaggcggcgttgtggaaggatgatgcgacctctaaagaagatttggaaagcgcgcaggatgcgcttgccgccgccaaagccaatgttgccgagttgaaggctttaatcagacagagcaaaatttccatcaataccgccgagtcggatttgggctacacgcgcattaccgcgacgatggacggcacggtggtggcgattcccgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggctacaacagcagtacggatacggcttccaatgcggtctattattatgcccgttcgtttgtgccgaatccggacggcaaactcgccacggggatgacgacgcagaatacggttgaaatcgacggtgtgaaaaatgtgttgcttattccgtcgctgaccgtgaaaaatcgcggcggcaaggcgttcgtacgcgtgttgggtgcggacggcaaggcagtggaacgcgaaatccggaccggtatgaaagacagtatgaataccgaagtgaaaagcgggttgaaagagggggacaaagtggtcatctccgaaataaccgccgccgagcagcaggaaagcggcgaacgcgccctaggcggcccgccgcgccga

SEQ ID NO: 5980 - protein, 392 aa, Neisseria gonorrhoeae
MAKMMKWAAVAAVAAAAVWGGWSYLKPEPQAAYITETVRRGDISRTVSATGEISPSNLVSVGAQASGQIKKLYVKLGQQVKKGDLIAEINSTTQTNTIDMEKSKLETYQAKLVSAQIALGSAEKKYKRQAALWKDDATSKEDLESAQDALAAAKANVAELKALIRQSKISINTAESDLGYTRITATMDGTVVAIPVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLLIPSLTVKNRGGKAFVRVLGADGKAVEREIRTGMKDSMNTEVKSGLKEGDKVVISEITAAEQQESGERALGGPPRR

SEQ ID NO: 5981 - DNA, 792 bp, Neisseria gonorrhoeae
ttgttgtttgaatttaaagagaataaaatgattgttgtttcccgctggcccttgctggaaaaggcgtttttacggtttggaatgcctgttgccgtggttgatttggaatcgacgggcggcaatctgtatgaagacagggtaaccgaagtggctttggtcaagtttgggcagggaagggcggagaggtatgaatggctggtcaatcctcaaaaaccgattccgaagtttgtggcggaactgacggggatttcagacggcatggttgccgacgcgccggtgtttgctgaaattgccggcgggttgttttcggtattgaaggggtgcgtgctggtggcgcacaacagccgtttcgactatacgtttttaaagcatgagtttcatcgtgcgggtatcggattttcatcgcctgctttgtgcagtgtgcagctttcgcgtcggctgtatccgcagttttacaagcacagcctggacggtatcatcgaaaggttggggattgttgtggaagacaggcatcgtgcgatggcggatgtatcggcgttgtgtgattatttggaatacagcctgtcggcacacgggcttgaggagtggagcaggcagtgtttccgtttgacgaatccgaaactttttcctgccgcgcttcccgaacggttgagggaacagctgtacggtttgcccgacggtacaggtgtgcttgcctgtttcgacggcgggggaaaagtaaattatatcggtacgtttgaacgggcatatggcgaggttgcggctttgttggattccggaaaagcccccgtt

SEQ ID NO: 5982 - protein, 264 aa, Neisseria gonorrhoeae
LLFEFKENKMIVVSRWPLLEKAFLRFGMPVAVVDLESTGGNLYEDRVTEVALVKFGQGRAERYEWLVNPQKPIPKFVAELTGISDGMVADAPVFAEIAGGLFSVLKGCVLVAHNSRFDYTFLKHEFHRAGIGFSSPALCSVQLSRRLYPQFYKHSLDGIIERLGIVVEDRHRAMADVSALCDYLEYSLSAHGLEEWSRQCFRLTNPKLFPAALPERLREQLYGLPDGTGVLACFDGGGKVNYIGTFERAYGEVAALLDSGKAPV

SEQ ID NO: 5983 - DNA, 279 bp, Neisseria gonorrhoeae
ttgcctcgccttgccgtactatttgtactgtctggggcttcgtcgcattgtcctgatttaaatttaatccactatattgaacggacaccgcatccggttacgggatatcggtttgcatggcaaaagtttgaatatgattcgattacgtctgagattctgatgaagtgggtaggtaaagatatggtaacgaattgccgaggcaataaaaatccccgagggattatttcggggatttggaatctggcacgcccacggggaatcgaaccccggttaccgccg

SEQ ID NO: 5984 - protein, 93 aa, Neisseria gonorrhoeae
LPRLAVLFVLSGASSHCPDLNLIHYIERTPHPVTGYRFAWQKFEYDSITSEILMKWVGKDMVTNCRGNKNPRGIISGIWNLARPRGIEPRLPP

SEQ ID NO: 5985 - DNA, 141 bp, Neisseria gonorrhoeae
atgaaaaatggttttaattgttttagaaccattactcaaatttggtattatactctaaatattgcagtggtaaacagaaaagcagaaggagctttggaatatgctgttatatctgtaccaatcggacaaaatatagtggat

SEQ ID NO: 5986 - protein, 47 aa, Neisseria gonorrhoeae
MKNGFNCFRTITQIWYYTLNIAVVNRKAEGALEYAVISVPIGQNIVD

SEQ ID NO: 5987 - DNA, 1173 bp, Neisseria gonorrhoeae
atgcagaatatttttgaccctttgattattcgtggaaaatcccttattcccatcgtgcaaggcggtatgggggtcggtgtttccgcatcgggtttatccagcgcggtggcgcgtgaaaacggcatcggaacgattgccagtgtagatttgcgccaccttcacgaagacctgctcgccgaatcccaaatcaatccgagtgaagagaaatatacgtctttgaactgtaccgcattagacagggaaatccaaaaagccaaaagtgcttcagagggaaaaggactgattgcggtcaacgtgatgaaggcggtcaaagaccacgccgcgtatgtccgccaggcttgcgaatcaggggcggatgcggtcgtgatgggtgccggcctgcctttagacctgccggaaatgaccgagggctatcataaggatgtcgcgctgctgccgattctgtccgaatcgcgcggtattaatatcgtcttgaaacgttggatgaaaaaaggcatattgcccgatgcgattgtagtcgaacatcctgcccatgcggccggacatttgggtgcatcaaccgttgaaggcgtaaacgatgccaaattcgacttcaaacgcgtgattgaggaaacgtttgaagtgtttaaaaatttggggctggagggagaaaaaatcccgcttattcttgcgggaggcatggcaaattttgaaaaagtcaaaaccgccctaaagaactggggagcctccgccgttcaaatcggtacggcttttgccgttaccgaagaaggagatgcacacctcaactttaaaaaaacgctcgccagtgcggaaactgaaaaagtagtcgaatttatgtctgttgccggtttgccggcgcgcggtatccgcaccaaattcctagacagctatatcaggcgcgaaggcaaacttcaggcaaacgccaaagccgacccgcgccgctgtacccaaggtttaaactgcctgaccagctgcggtctgcgcgacgggctttccaaagcagggcaattctgtattgatatccagcttgctgccgcattccgtggagaagttgataaggggttgtttttcaggggaaaagaccagcttcccttcggtaatgccatccgcaccgtccgcgaaacgatacaatatctgctgacggggagcgaacctgttgcaacgctcggacgc

SEQ ID NO: 5988 - protein, 391 aa, Neisseria gonorrhoeae
MQNIFDPLIIRGKSLIPIVQGGMGVGVSASGLSSAVARENGIGTIASVDLRHLHEDLLAESQINPSEEKYTSLNCTALDREIQKAKSASEGKGLIAVNVMKAVKDHAAYVRQACESGADAVVMGAGLPLDLPEMTEGYHKDVALLPILSESRGINIVLKRWMKKGILPDAIVVEHPAHAAGHLGASTVEGVNDAKFDFKRVIEETFEVFKNLGLEGEKIPLILAGGMANFEKVKTALKNWGASAVQIGTAFAVTEEGDAHLNFKKTLASAETEKVVEFMSVAGLPARGIRTKFLDSYIRREGKLQANAKADPRRCTQGLNCLTSCGLRDGLSKAGQFCIDIQLAAAFRGEVDKGLFFRGKDQLPFGNAIRTVRETIQYLLTGSEPVATLGR

SEQ ID NO: 5989 - DNA, 90 bp, Neisseria gonorrhoeae
atgccgtccgaagggctttcagacggcgtttttcaggttgtgttccggaacagtgtcgaaaaaacggagagaaataaaaacgtttttata

SEQ ID NO: 5990 - protein, 30 aa, Neisseria gonorrhoeae
MPSEGLSDGVFQVVFRNSVEKTERNKNVFI

SEQ ID NO: 5991 - DNA, 192 bp, Neisseria gonorrhoeae
ttgcaaacaaaatgccgtccgaagggctttcagacggcgtttttcaggttgtgttccggaacagtgtcgaaaaaacggagagaaataaaaacgtttttatatgaacaaaatgccttccgcattatgtcggacatacaacacaaatgccgtctgaagcctttcagacggcatttttcaggctgcctttcggaa

SEQ ID NO: 5992 - protein, 64 aa, Neisseria gonorrhoeae
LQTKCRPKGFQTAFFRLCSGTVSKKRREIKTFLYEQNAFRIMSDIQHKCRLKPFRRHFSGCLSE

SEQ ID NO: 5993 - DNA, 117 bp, Neisseria gonorrhoeae
atgccgtctgaagcctttcagacggcatttttcaggctgcctttcggaatgatgttaaaaaataaacgggatgagatacatttattttcgtccgacaaatcagaccatcacgccgaa

SEQ ID NO: 5994 - protein, 39 aa, Neisseria gonorrhoeae
MPSEAFQTAFFRLPFGMMLKNKRDEIHLFSSDKSDHHAE

SEQ ID NO: 5995 - DNA, 120 bp, Neisseria gonorrhoeae
ttgttatatgcaatgtcgggcaggcattgtttgattattcggcgtgatggtctgatttgtcggacgaaaataaatgtatctcatcccgtttattttttaacatcattccgaaaggcagcc

SEQ ID NO: 5996 - protein, 40 aa, Neisseria gonorrhoeae
LLYAMSGRHCLIIRRDGLICRTKINVSHPVYFLTSFRKAA

SEQ ID NO: 5997 - DNA, 546 bp, Neisseria gonorrhoeae
gtgtctcaaaacaatccaatcaagccttggtacaaacacgtctggccgtgggtcttgatggcggggccgatttttgtcgtcatcgccagcgtcgctatgttttttgtcgcgcagcagcacgcgacagatttggttacggacgattattataaggatggcaagcatatcgacatccagcttcatcgggatgaagaagccgtcagacggcatatcggggtgcaggtcctcatttctcccgatatgaatgcggcaaaagtgtttgtcggcggcgagtttgacggcaaacagcctttgaacctgctgctgatgcacccgacccgcaaggcggacgatcaaaccgtcgccctcaagcccgtcggcagcgcgcagaacggcagggcggaatatgaggcggtgttcaaaacccttccgccggccaaccactggtatgtgcgcgtggaggacgcggcaggcgtgtggcgcgtcgagaacaaatggattaccagccagggcaatgcggtcgatttgaccccgatggacaaacttttcaataatgcaggaagcaaa

SEQ ID NO: 5998 - protein, 182 aa, Neisseria gonorrhoeae
VSQNNPIKPWYKHVWPWVLMAGPIFVVIASVAMFFVAQQHATDLVTDDYYKDGKHIDIQLHRDEEAVRRHIGVQVLISPDMNAAKVFVGGEFDGKQPLNLLLMHPTRKADDQTVALKPVGSAQNGRAEYEAVFKTLPPANHWYVRVEDAAGVWRVENKWITSQGNAVDLTPMDKLFNNAGSK

SEQ ID NO: 5999 - DNA, 1644 bp, Neisseria gonorrhoeae
ttgtacaatagcgggaatatattttgggaaaagcggattttctcaaaacttgaaacacaatgccttaaaaaaacaagaaaaatgacgtctgaaaagcaaaacggcggcggtaacgggcaaaccatcaatcaaaaatctaaggaatgcagaatgaccacggaaaaccaagccggcagtccggcatccggaatcggcacgtccgaacaaacaaaagccgcgccgaaagtgaaaaaaacgttcgatccgcgtgccagcgtgattcaaatccatcccgaaggcgaacgcatccatcccaaaaaggcggaaggacggttcgccaaactgcgtatcgccgccgtattggcgacccagtttgtgttttacgtcattccgtggttcaactggagcggaaggcaggccgtcgttttcaatatccccgaacggcatttcttcattttcggattgtcgttgggggtgggcgatttgatttaccttgccctgctgctgatgatttgcgccttcgggctgttttggtggacgacgattgccggccgtttgtggtgcggctattcctgcccgcaaacggtttacaccgaaattatgctgtggatcgacaacctggtcgaaggcgatagaaacaaacgcctgaagctggaaaaatcgccgtggaatttcaccaaaatccgcatcaaagccaccaaatacctgttgattttccttgtctgcgcgtggacgggcatcacgtttgccggctggtttgtccccatccgccagtttgttcccgatttattcaccggagcagcaggcggcggcgcgatgtttgccgcagcgttttacggctttatgaccttcttcttcgcccatattatgcgcgaaaaagtgtgcctgcatatgtgtccgtacgcacgtttccaaagcgcgatgttcgataaggacacgctgattgtttcttatgacgcggaacgcggcgaaccgcgcggcgcccgcaagaaaacggtcaacaaggaagaggcgggtttgggcgactgcatcaactgtgcgatgtgcgtccaagtctgccccgtcggcatcgacatccgcaacggcctgcaataccaatgtatcggctgcgccgcctgtatcgacgcgtgcgatgagattatggacaaaatgggttatccgagcggtttgatacgctatacgaccgaaagcgcgctggaacacgaatatgccgaaaaagacattaaaaaacggctgctcagaccgcgcgtggcaggttacggcgcggtgttggcagtggttgtcgccgccttcctggtcggtttgtccacgcgcaaaatggtcgaagtcgatattctgaaagaccgtggcgtaatggtgcgcgaaaacgccaaaggttggctggaaaacgcatatagcctgcgtatcatcaacaacagcgaaaaagaacagctgattaccgcaagtgtcaaaggatttgacgaaatcgccctgaccgggctgcctgaaggcggtataaaagtggctccgcgcgaaacaataacccttcccgtccaagtgtccaccattccggaatacgcggacaaaggcagtcatcctatcgagtttatcttccaataccgggaaagcggtgcatcagacggcaagccggttgttttggaagaagacgcaacctttatcggagaa

SEQ ID NO: 6000 - protein, 548 aa, Neisseria gonorrhoeae
LYNSGNIFWEKRIFSKLETQCLKKTRKMTSEKQNGGGNGQTINQKSKECRMTTENQAGSPASGIGTSEQTKAAPKVKKTFDPRASVIQIHPEGERIHPKKAEGRFAKLRIAAVLATQFVFYVIPWFNWSGRQAVVFNIPERHFFIFGLSLGVGDLIYLALLLMICAFGLFWWTTIAGRLWCGYSCPQTVYTEIMLWIDNLVEGDRNKRLKLEKSPWNFTKIRIKATKYLLIFLVCAWTGITFAGWFVPIRQFVPDLFTGAAGGGAMFAAAFYGFMTFFFAHIMREKVCLHMCPYARFQSAMFDKDTLIVSYDAERGEPRGARKKTVNKEEAGLGDCINCAMCVQVCPVGIDIRNGLQYQCIGCAACIDACDEIMDKMGYPSGLIRYTTESALEHEYAEKDIKKRLLRPRVAGYGAVLAVVVAAFLVGLSTRKMVEVDILKDRGVMVRENAKGWLENAYSLRIINNSEKEQLITASVKGFDEIALTGLPEGGIKVAPRETITLPVQVSTIPEYADKGSHPIEFIFQYRESGASDGKPVVLEEDATFIGE

SEQ ID NO: 6001 - DNA, 120 bp, Neisseria gonorrhoeae
ttgtacaactttatgcgccgtccggatgtattgggcgaatacatttcccatccgcatcaaaacgccctgattttaccgcaccgcccgaacaaaattaaaatactcttaaaaaacaaagac

SEQ ID NO: 6002 - protein, 40 aa, Neisseria gonorrhoeae
LYNFMRRPDVLGEYISHPHQNALILPHRPNKIKILLKNKD

SEQ ID NO: 6003 - DNA, 198 bp, Neisseria gonorrhoeae
atgctttcaagaaaagggcggacgcgggggaaggcggcggcagggggtgggcggtggggaaggattttcgatttgcgggcgaagcctgccattattccttttgaaataaaacgttatagattgtgtgccggattgttgatagcgtttgtttatgagcttgcgccggcggttctgccgataagggggtgtctgtttttt

SEQ ID NO: 6004 - protein, 66 aa, Neisseria gonorrhoeae
MLSRKGRTRGKAAAGGGRWGRIFDLRAKPAIIPFEIKRYRLCAGLLIAFVYELAPAVLPIRGCLFF

SEQ ID NO: 6005 - DNA, 1977 bp, Neisseria gonorrhoeae
atgtctcaactggcaaacgtaatccgcttcctctcggccgatgccgttcaaaaagccaattccggccaccccggcgcgcctatgggtatggcggaaatggcggaaacattgtggacgaaattcctcaatcacaatcccgccaatcccaaattctacaaccgcgaccgcttcgtcctctccaacggtcatgcgtctatgctgttgtacagcctgctgcacctgaccggctacaacctgagcattgaagatctgaaaaacttccgccagctgcacagcaaaacccccggccatcccgaatacggctacaccgacggcgtggaaaccacgaccggcccgttggggcaaggtattgccaacgcagtgggcatggcattggcagaaaaaatccttgccgccgaatttaataaagacggtttgaacatcgtcgatcactacacttacgtctttatgggcgacggctgcctgatggaaggcgtatcgcacgaagcctgctcactcgccggcaccttgggcttgggcaaactgattgttttgtatgacgataacaatatctccatcgacggcaaagtggacggctggtttaccgaaaacatcccgcaacgctttgaaagctacggctggcacgtcgttcccaacgtaaacggccacgacaccgccgccattcagacggccatcgaagccgcccgcgccgaaaccggcaagccgtccatcatctgctgcaaaaccttaatcggcaaaggcagcgccaacaaagaaggcagccacaaaacccacggcgcgcctttgggtgcggacgaaatcgaagccacgcgcaaacatttgggttgggcttatcctgcgtttgaaatcccgcaagaaatttacgatgcgtggaatgccaaagaaaaaggcgcgaaactggaagccggatggaacgaactgttcgcgcaatatcaagccaaatatcctgccgaagccgcagaattcgtgcgccgcatggataaaaagctgccggaaaactttgacgagtacgttcagacggcattgaaagaagtgtgcgccaaagcggaaaccgtcgccacccgcaaagccagccaaaacagcatcgaaatcttggcaaaagagctgcccgaactggtgggcggttctgccgacctgaccccgtccaacctgaccgactggtcaaacagcgtctccgttacccgcgacaaaggcggcaactacatccactacggcgtgcgcgagttcggtatgggtgcgattatgaacggtttggtattgcacggcggtgtaaaacccttcggcgcgactttcctgatgttcagcgaatacgaacgcaacgccttacgcatggcggcactgatgaaaatcaaccccgtcttcgtatttacccacgattccatcggtttgggcgaggacggcccaacccaccagcctatcgagcaaaccgccaccctgcgcctgattccgaatatggacgtatggcggccgtgcgacaccgcagaatctctggtcgcttgggcagaagcggcaaaagccgaagaccacccgtcctgcctgattttcagccgtcaaaacctgaaattccaagcacgcagcgagcaacaactgaacgacatcaaacgcggtgcttacgtaatcagtgaagcccaaggcaacgcccaagccgtcatcattgccaccggttccgaggtaggattggctgtagaagcgcaaaaagtattggcaggacaaggtattgccgtgcgcgtcgtttccatgccgtccaccagcgtcttcgaccgccaagacgccgcctatcaagccgccgtcctaccggaaggcctgccgcgcatcgccgtagaagccggacacaccaacggctggtacaaatatgtcggactgaacggcgcagtcgtcggcatcaaccgcttcggcgaatccgcccctgccgatctgctgttcaaagcattcggctttaccgtggacaatgtggttgatacggtgaaatccgtgctg

SEQ ID NO: 6006 - protein, 659 aa, Neisseria gonorrhoeae
MSQLANVIRFLSADAVQKANSGHPGAPMGMAEMAETLWTKFLNHNPANPKFYNRDRFVLSNGHASMLLYSLLHLTGYNLSIEDLKNFRQLHSKTPGHPEYGYTDGVETTTGPLGQGIANAVGMALAEKILAAEFNKDGLNIVDHYTYVFMGDGCLMEGVSHEACSLAGTLGLGKLIVLYDDNNISIDGKVDGWFTENIPQRFESYGWHVVPNVNGHDTAAIQTAIEAARAETGKPSIICCKTLIGKGSANKEGSHKTHGAPLGADEIEATRKHLGWAYPAFEIPQEIYDAWNAKEKGAKLEAGWNELFAQYQAKYPAEAAEFVRRMDKKLPENFDEYVQTALKEVCAKAETVATRKASQNSIEILAKELPELVGGSADLTPSNLTDWSNSVSVTRDKGGNYIHYGVREFGMGAIMNGLVLHGGVKPFGATFLMFSEYERNALRMAALMKINPVFVFTHDSIGLGEDGPTHQPIEQTATLRLIPNMDVWRPCDTAESLVAWAEAAKAEDHPSCLIFSRQNLKFQARSEQQLNDIKRGAYVISEAQGNAQAVIIATGSEVGLAVEAQKVLAGQGIAVRVVSMPSTSVFDRQDAAYQAAVLPEGLPRIAVEAGHTNGWYKYVGLNGAVVGINRFGESAPADLLFKAFGFTVDNVVDTVKSVL

SEQ ID NO: 6007 - DNA, 96 bp, Neisseria gonorrhoeae
gtgattcgcaaatattataatggagattggcggaatgaggaagcatcaaggcgggagggcaaaaaaatgccgtctgaaaagcattcagacggcatt

SEQ ID NO: 6008 - protein, 32 aa, Neisseria gonorrhoeae
VIRKYYNGDWRNEEASRREGKKMPSEKHSDGI

SEQ ID NO: 6009 - DNA, 228 bp, Neisseria gonorrhoeae
atgttttcaattctctgtatgcgtcaatcccataaaccggaagcggattctaccgcaggtccctgccccatccaaggcggcaaaccgccgacattaaaaataaccattggttttaaagggcttatacaatctgctttcccgaaaatttcaatccgtttacatattccgccatttccgatacggcgttataatgccgcccacaaacaaccaaatggaaacacattgcta

SEQ ID NO: 6010 - protein, 76 aa, Neisseria gonorrhoeae
MFSILCMRQSHKPEADSTAGPCPIQGGKPPTLKITIGFKGLIQSAFPKISIRLHIPPFPIRRYNAAHKQPNGNTLL

SEQ ID NO: 6011 - DNA, 495 bp, Neisseria gonorrhoeae
gtgtggaaaagttgtatcaataaaagcagtatatatttgaaaaagggaaacatctatactctgccgcctgaaatgaagacaaatatcaaaggagcttttatgtccgattgctgcaaccgtatccaacctgttttgctttctgttttgcgtatcgtaaccgcctacctgtttttgttgcacggtacgtcgaaaatcttcgccttccccattgaaatgggcagcggttcgcccggcgggctgttgctgcttgccggtattttagaaattgtcggcggcattttgctggtgttgggcctgtttgcgcgccctgccgcgtttgttttgtccggccagatggcggttgcctattttatggcgcacgcttccggaaatgctttgttcccgattgccaacggcggcgagtccgcagtgctgttctgcttcgtatttctctatatcgcggcagcgggcggcggagcatggtcgctggacaggctgtttttcaagcgtaaagcc

SEQ ID NO: 6012 - protein, 165 aa, Neisseria gonorrhoeae
VWKSCINKSSIYLKKGNIYTLPPEMKTNIKGAFMSDCCNRIQPVLLSVLRIVTAYLFLLHGTSKIFAFPIEMGSGSPGGLLLLAGILEIVGGILLVLGLFARPAAFVLSGQMAVAYFMAHASGNALFPIANGGESAVLFCFVFLYIAAAGGGAWSLDRLFFKRKA

SEQ ID NO: 6013 - DNA, 1359 bp, Neisseria gonorrhoeae
atgggcaatgtcgaagtcccgtccgaagcctattggggcgcgcagacccagcgcagccgcaacaatttcaaaatcggcggcgaaaccctgccgcagccgctgatttacgctttggcgttggtgaaaaaagccgccgccgcgaccaatgtttccctcggcaggattaagcccgaacaggcggatttgattacgcaggcggcggatgatgtactgaacggcaggctcgacgggcagttccccttagtggtttggcagaccggctccggtacgcagtccaatatgaacatgaacgaagtgctggcaaaccgcgccaacgaaattgcaggtacgggtttggcggcgtaccggcccgtccaccccaacgaccatgtgaaccacgcgcaatcgaccaacgacgcgttcccgaccgccatccacgtcgccgccgcgattgaaatcaaccgccaccttattccggcggtaaaagccttgcgcgatacattggacaaaaaagcccaagccttcgcccccatcgtcaaaatcggccgtacccacttgcaggatgcgacgccgctgactttgggacaagaattttccggctacgtttcccaactcgaccacagcttaggccgtctgaacgacgcgctcaaaggtttgtacgaactcgccttgggtggaacggcggtcggtacgggtttgaacagccatcccgaatacgctgaaatagccgccgccaaactcgccgaactgtccggcctgccgtttgtcagcgcgccgaacaaatttgaagccttgggcggacgcgatgccgccgttgccgcttcgggcgcattgaaaacgctggcggcaagcctgaacaaaatcgccaacgacatccgctggctggcaagcggcccgcgctgcggcttgggcgaaatcaaaatccccgaaaacgaaccgggttcgtccattatgccgggcaaagtcaacccgacccaatgcgaagcgatgacgatggtgtgctgccaagtgttcggcaacgacgttaccatcggtatggcgggcgcgtcgggcaatttcgagctgaacgtctatatgcccgtcatcgcttacaacctcttgcaatccatccgcctcttgggcgacgcgtgcaacagcttcaacgaaaactgcgccgccggcatcgaacccgtaccggaaaaaatcgactatttcctgcaccattccctgatgctggttactgcgttaaaccgcaaaatcggctacgaaaacgccgccaaagtcgccaaaaccgcctacaaaaacgataaatcgctgcgcgaaactgccgttgggttgggcttgctgacgggcgaagagtttgacgaactggtcgtccctgccgatatggttcatccgcgc

SEQ ID NO: 6014 - protein, 453 aa, Neisseria gonorrhoeae
MGNVEVPSEAYWGAQTQRSRNNFKIGGETLPQPLIYALALVKKAAAATNVSLGRIKPEQADLITQAADDVLNGRLDGQFPLVVWQTGSGTQSNMNMNEVLANRANEIAGTGLAAYRPVHPNDHVNHAQSTNDAFPTAIHVAAAIEINRHLIPAVKALRDTLDKKAQAFAPIVKIGRTHLQDATPLTLGQEFSGYVSQLDHSLGRLNDALKGLYELALGGTAVGTGLNSHPEYAEIAAAKLAELSGLPFVSAPNKFEALGGRDAAVAASGALKTLAASLNKIANDIRWLASGPRCGLGEIKIPENEPGSSIMPGKVNPTQCEAMTMVCCQVFGNDVTIGMAGASGNFELNVYMPVIAYNLLQSIRLLGDACNSFNENCAAGIEPVPEKIDYFLHHSLMLVTALNRKIGYENAAKVAKTAYKNDKSLRETAVGLGLLTGEEFDELVVPADMVHPR

SEQ ID NO: 6015 - DNA, 921 bp, Neisseria gonorrhoeae
atggaaaaccaaaggccgctcctaggcttcgcgttggcacttttggcggcgatgacgtgggggacgctgccgattgccgtgcggcaggtattgaagtttgtcgatgcgccgacgctggtgtgggtgcgttttaccgtggcggcggcggtattgtttgttttgctggcattgggcgggcggctgccgaagcggcgggatttttcttggcattcattcaggctgctgctgctcggcgtgacgggcatttcggcaaactttgtgctgattgcccaagggctgcattatatttcgccgaccacgacgcaggttttgtggcagatttcgccgtttacgatgattgttgtcggcgtgttggtgtttaaagaccggatgactgccgcgcagaaaatcggtttggttttgctgcttgtcggtttgcttatgttttttaacgacaaattcggcgagttgtcgggtttgggcgcgtatgcgaagggcgtgttgctgtgtgcggcaggcagtatggcctgggtgtgttatgccgtggcgcaaaagctgctgtcggcgcaattcgggccgcaacagattctgctgttgatttatgcggcaagtgccgccgtgttcctgccgtttgccgaaccggcacacatcggaagtttggacggtacgttggcgtgggtttgttttgtgtattgctgcttgaatacgttaatcggttacggctcgttcggcgaggcgttgaaacattgggaggcttccaaagtcagcgcggtaacaaccttgctccccgtgtttaccgtaatattttctttgctcgggcattatgtgatgcctgatacttttgccgcgccggatatgaacggtttgggttatgtcggcgcactggtcgtggtcgggggtgcggttacggcggcggtgggggacaggccgttcaaacgccgc

SEQ ID NO: 6016 - protein, 307 aa, Neisseria gonorrhoeae
MENQRPLLGFALALLAAMTWGTLPIAVRQVLKFVDAPTLVWVRFTVAAAVLFVLLALGGRLPKRRDFSWHSFRLLLLGVTGISANFVLIAQGLHYISPTTTQVLWQISPFTMIVVGVLVFKDRMTAAQKIGLVLLLVGLLMFFNDKFGELSGLGAYAKGVLLCAAGSMAWVCYAVAQKLLSAQFGPQQILLLIYAASAAVFLPFAEPAHIGSLDGTLAWVCFVYCCLNTLIGYGSFGEALKHWEASKVSAVTTLLPVFTVIFSLLGHYVMPDTFAAPDMNGLGYVGALVVVGGAVTAAVGDRPFKRR

SEQ ID NO: 6017 - DNA, 417 bp, Neisseria gonorrhoeae
ttgacgacgacatcccgttctgaattttacggccggacatcctcgcggagggaagtcataaaggacggaaaaaccttaaaccttacggggcaaggtttctcttttttgcatttgggccggcttgttgccgccccctgcgttgggcgtaacgttgcgattgcgccgttcgggcgttttgaggcaagcgatgcctgccgcactcccccgctgttttcagacggcattttaaaattgaggcggtgttttcaaatagtgcgaagcaatagtcgggcttcagccagtttgtttgaaatcaaagggttggaatcaaacgccaaacgcttgaaccatcattgcccgatgcggcaaaccggcatcgtccggcaatacggttgtttaaaaatagggaaatcaggatggaaaaccaaaggccgctcc

SEQ ID NO: 6018 - protein, 139 aa, Neisseria gonorrhoeae
LTTTSRSEFYGRTSSRREVIKDGKTLNLTGQGFSFLHLGRLVAAPCVGRNVAIAPFGRFEASDACRTPPLFSDGILKLRRCFQIVRSNSRASASLFEIKGLESNAKRLNHHCPMRQTGIVRQYGCLKIGKSGWKTKGRS

SEQ ID NO: 6019 - DNA, 522 bp, Neisseria gonorrhoeae
atgtcattgaacaaagtcatccttatcggccgcctcggacgcgatcccgaagtgcgctatatgcccaacggcgaggcagtgtgtaatttcagcgtcgccaccagcgaaacttggaacgaccgcaacggccagcgcgtagagcgcaccgaatggcacaacatcacgatgtaccgcaaactggcggaaattgccgggcaatacctcaaaaaaggcgggctggtttatctggaaggcagaatccaaagccgcaaataccaaggcaaagacggcatcgaacgcaccgcttacgatattgtcgccaatgaaatgaaaatgttgggcgggcgcaatgaaaacagcggcggcgcgccttacgatgaaggttacggtcagagtcaggaggcttaccaacgccccgctcagcaaagccggcagcccgctcccgacgcgccgtcccatccccaagaagcacccgccgcgccgcgccgccaacccgtgccggccgccgccccggtcgaggacattgacgacgacatcccgttc

SEQ ID NO: 6020 - protein, 174 aa, Neisseria gonorrhoeae
MSLNKVILIGRLGRDPEVRYMPNGEAVCNFSVATSETWNDRNGQRVERTEWHNITMYRKLAEIAGQYLKKGGLVYLEGRIQSRKYQGKDGIERTAYDIVANEMKMLGGRNENSGGAPYDEGYGQSQEAYQRPAQQSRQPAPDAPSHPQEAPAAPRRQPVPAAAPVEDIDDDIPF

SEQ ID NO: 6021 - DNA, 1413 bp, Neisseria gonorrhoeae
ttgcaactgttgatgccgtctgaaaaattatttatggcaagagacaaccgcatccaaatgtttccgcacgaatggcgcgccagtacgacgctttccggcgtgtacgcgctgcgtatgctgggtatgttcctcgtgctgcccgttttggcaatatatgccgcctcgctgcccggtgcggaagacaataaaacgctggtcgggctggcaatgggcatttacgggctgacgcaggcattgctgcaactgcctttgggtatcgcttccgacaagttcgggcgcaagaaaaccatttatgtcgggctggtcgtgtttgccgccggcagcttccttgccgccgccgccgatacgctgcccatgctggttgccgcgcgcgccatacagggcgcgggggcggtcagtgctgccgtaaccgcgctgcttgccgacttgacgcgcgacggcgtgcgtacccgcgcgatggcgatgatcggtttgagtatcggtctgacgttttcggtcagcctggtggttgcgccgatgattgccgatgtggccggcgttcgcggactgtttatgctgaccggcattctgaccgccatcagcatcggcgtagtggcgtggatgactcctgatcccgaagtttccaagctgcatgaggacacgcaggcgcagccttcgcgcataggagaagttttgaaaaaccgtaggctgctgacgctcgatttcggcattttcgccctgcacgccgcgcaaatggcattgtttaccgcgctgcctttcgcgatgacccggctcggtttggaaaaaatccagcattggaaagtatatctgccctcgaccattacgggcttggtggtgatggttccgctgattatcgtcggcgaaacgcgcaacaagctcaaacaggtttttgttttgggcatcgtctgcatcgcggcggcgcagcttggtttgctgtccggaatgcactcgatttggctgattaccgcttatctggttgtttactttatcggttttaatgtgttggaagcgagcctgccgtctatggtttccaaaatcgcgccgtccgacctgaagggtacggcgatgggcgtgtacaacacgatgcagtcgctcggactgtttgccggcggcgcggcaggaggcttgctgtttcaaaaatgcggctttgccggcgtgtttgccttttgcagcatattgatgctgctgtggctggtgattgccgttttatcgcccgcgcccaagcccgtcaaaaacctcagttaccctgtcggcggcgtgtggcagggcaatcgggacggtttgcaacgcgccctgttgcagttggaaggcgtggaagacatcggtttcagtttcgacgggcagaccgtctatcttaaagtgttgcagaagggtttcgatcaggctgccgctgaaaaaatcattacaggagtt

SEQ ID NO: 6022 - protein, 471 aa, Neisseria gonorrhoeae
LQLLMPSEKLFMARDNRIQMFPHEWRASTTLSGVYALRMLGMFLVLPVLAIYAASLPGAEDNKTLVGLAMGIYGLTQALLQLPLGIASDKFGRKKTIYVGLVVFAAGSFLAAAADTLPMLVAARAIQGAGAVSAAVTALLADLTRDGVRTRAMAMIGLSIGLTFSVSLVVAPMIADVAGVRGLFMLTGILTAISIGVVAWMTPDPEVSKLHEDTQAQPSRIGEVLKNRRLLTLDFGIFALHAAQMALFTALPFAMTRLGLEKIQHWKVYLPSTITGLVVMVPLIIVGETRNKLKQVFVLGIVCIAAAQLGLLSGMHSIWLITAYLVVYFIGFNVLEASLPSMVSKIAPSDLKGTAMGVYNTMQSLGLFAGGAAGGLLFQKCGFAGVFAFCSILMLLWLVIAVLSPAPKPVKNLSYPVGGVWQGNRDGLQRALLQLEGVEDIGFSFDGQTVYLKVLQKGFDQAAAEKIITGV

SEQ ID NO: 6023 - DNA, 621 bp, Neisseria gonorrhoeae
atgaaaaaaccgaccgataccctacccgtcaatctgcaacgccgccgcctgctgtgtgccgccggcgcgctgttgatcagcccgctggcgcacgccggcgcgcaacgtgaagaaacgcttgccgacgatgtggcttccgtgatgaggagttctgtcggcagcgtcaatccgccgaggctggtgttcgacaatccgaaagagggcgaacgttggttgtccgcgatgtcggcacgtttggcaagattcgtccccgacgagggggagcggcgcaggctgctggtcaatatccaatacgaaagcagccgggccggtttggatacgcagattgtgttggggctgattgaagtggaaagcgcgttccggcagtatgcgataagcggggtcggcgcgcgcggtctgatgcaggttatgccgttttggaaaaactacatcggcaaaccggcgcacaacctgttcgatatccgtaccaacctgcgttacggctgcaccatcctgcgccattaccgaaaccttgaaaagggcgacatcgtccgcgcacttgcccgcttcaacggcagcctcggcagcaataaatatccgaacgccgttttgggcgcgtggcgcaaccgctggcagtggcgt

SEQ ID NO: 6024 - protein, 207 aa, Neisseria gonorrhoeae
MKKPTDTLPVNLQRRRLLCAAGALLISPLAHAGAQREETLADDVASVMRSSVGSVNPPRLVFDNPKEGERWLSAMSARLARFVPDEGERRRLLVNIQYESSRAGLDTQIVLGLIEVESAFRQYAISGVGARGLMQVMPFWKNYIGKPAHNLFDIRTNLRYGCTILRHYRNLEKGDIVRALARFNGSLGSNKYPNAVLGAWRNRWQWR

SEQ ID NO: 6025 - DNA, 2376 bp, Neisseria gonorrhoeae
atgaaactgaaacagattgcctccgcactgatgatgttgggcatatcgcctttggcatttgccgacttcaccatccaagacatccgtgtcgaaggcttgcagcgtaccgagccgagcaccgtattcaactacctgcccgtcaaagtcggcgacacctacaacgacacacacggcagtgccatcatcaaaagcctgtacgccaccggtttctttgacgacgtacgagtcgaaactgcggacgggcagcttctgctgaccgttatcgaacgccccaccatcggctcgctcaacatcaccggcgccaaaatgctgcaaaacgacgccatcaagaaaaacctcgaatcgttcgggctggcgcagtcgcaatactttaatcaggcgacactcaaccaggcagtcgccggcctgaaagaagaatacctcgggcgtggcaaactcaatatccaaatcacgcccaaagtaaccaaactcgcccgcaaccgcgtcgacatcgacatcacgattgacgagggcaaatccgccaaaatcaccgacatcgaatttgaaggcaaccaagtctattccgaccgcaaactgatgcggcagatgtcgctgaccgaaggcggcatttggacatggctgacacgaagcgaccggttcgaccgccagaaattcgcccaagacatggaaaaagtaaccgacttctaccagaacaacggctacttcgatttccgtatcctcgataccgacatccaaaccaacgaagacaaaaccaggcagaccatcaaaatcaccgtccacgaaggcggacgtttccgctggggcaaagtgtcgattgaaggcgacaccaacgaagtccccaaggccgaactggaaaaactgctgaccatgaagcccggcaaatggtacgaacgccagcagatgaccgccgttttgggtgagattcagaaccgcatgggctcggcaggctacgcatacagcgaaatcagcgtacagccgctgccgaacgccggaaccaaaaccgtcgatttcgtcctgcacatcgaaccgggccggaaaatctacgtcaacgaaatccacatcaccggcaacaacaaaacccgcgacgaagtcgtgcgccgcgaattgcgccaaatggaatccgcgccttacgacacctccaagctgcaacgctccaaagagcgcgtcgagcttttgggctacttcgacaacgtacagtttgatgccgtcccgcttgccggtacgcccgacaaagtcgatttgaacatgagcctgaccgaacgctccaccggctcgctcgacttgagcgcgggctgggttcaggataccggcttggtcatgtccgccggcgtatcgcaggacaacctgttcggtacgggcaagtcggccgccctgcgcgcctcgcgaagcaaaaccacgctcaacggctcgctgtcgtttaccgacccgtacttcacggcagacggggtcagcctgggctacgatatttacggaaaagccttcgacccgcgcaaagcatcgaccagcgtcaaacaatataaaaccaccaccgccggcggcggcgtaaggatgggtatccccgttaccgaatacgaccgcgtcaatttcgggctggcggcggaacacctgaccgtcaacacctacaacaaagcacccaaacgctatgccgactttatcaggaaatacggcaaaaccgacggcgcagacggcagcttcaaaggcctgctgtacaaaggcaccgtcggctgggggcgcaacaagaccgacagcgcgtcatggccgacgcgcggctacctgaccggcgtaaatgccgaaatcgccctgcccggcagcaaactgcaatactactccgccacccacaaccaaacctggttcttccccttaagcaaaaccttcacgctgatgctcggcggcgaagtcggcattgcgggcggctacggcagaaccaaagaaatccccttctttgaaaacttctacggcggcggcctgggttcggtgcgcggctacgaaagcggcacgctcggcccgaaagtgtatgacgaatacggcgaaaaaatcagctacggcggcaacaaaaaagccaacgtctccgccgagctgctcttcccgatgcccggtgcgaaagacgcacgcaccgtccgcctgagcctgtttgccgacgcaggcagcgtgtgggacggcagaacctataccgccgccgaaaacggtaacaacaaatcggtttactcggaaaacgcgcataaatccacctttaccaacgaattgcgctattccgccggcggcgcggttacctggctctcgcctttgggtccgatgaaattcagctacgcctacccgctgaagaaaaaaccggaagacgaaatccaacgcttccaattccagctcggcacgacgttc

SEQ ID NO: 6026 - protein, 792 aa, Neisseria gonorrhoeae
MKLKQIASALMMLGISPLAFADFTIQDIRVEGLQRTEPSTVFNYLPVKVGDTYNDTHGSAIIKSLYATGFFDDVRVETADGQLLLTVIERPTIGSLNITGAKMLQNDAIKKNLESFGLAQSQYFNQATLNQAVAGLKEEYLGRGKLNIQITPKVTKLARNRVDIDITIDEGKSAKITDIEFEGNQVYSDRKLMRQMSLTEGGIWTWLTRSDRFDRQKFAQDMEKVTDFYQNNGYFDFRILDTDIQTNEDKTRQTIKITVHEGGRFRWGKVSIEGDTNEVPKAELEKLLTMKPGKWYERQQMTAVLGEIQNRMGSAGYAYSEISVQPLPNAGTKTVDFVLHIEPGRKIYVNEIHITGNNKTRDEVVRRELRQMESAPYDTSKLQRSKERVELLGYFDNVQFDAVPLAGTPDKVDLNMSLTERSTGSLDLSAGWVQDTGLVMSAGVSQDNLFGTGKSAALRASRSKTTLNGSLSFTDPYFTADGVSLGYDIYGKAFDPRKASTSVKQYKTTTAGGGVRMGIPVTEYDRVNFGLAAEHLTVNTYNKAPKRYADFIRKYGKTDGADGSFKGLLYKGTVGWGRNKTDSASWPTRGYLTGVNAEIALPGSKLQYYSATHNQTWFFPLSKTFTLMLGGEVGIAGGYGRTKEIPFFENFYGGGLGSVRGYESGTLGPKVYDEYGEKISYGGNKKANVSAELLFPMPGAKDARTVRLSLFADAGSVWDGRTYTAAENGNNKSVYSENAHKSTFTNELRYSAGGAVTWLSPLGPMKFSYAYPLKKKPEDEIQRFQFQLGTTF

SEQ ID NO: 6027 - DNA, 342 bp, Neisseria gonorrhoeae
atgattgcttccaacgcgaaaaaccgcgcgcaaaatccaagcgcggcatatcgccctgcccttttcgggcaaaccttgattttaccgccctcaagaacgcttgtccaaacaggcacagacgacaccgcccgggcatttcccgttttcaccggttatccgtcgtccggattgtgcagcagcaccatcagcgcattacgcttttcgggcggcagcaggcggaaatatagtggattaaatttaaaccggtacggcgttgcctcgccttgccgtaccggtttaaatttaatccactatatcttgagacctttgcaaaattcccttccctcccgacagctgaaaccc

SEQ ID NO: 6028 - protein, 114 aa, Neisseria gonorrhoeae
MIASNAKNRAQNPSAAYRPALFGQTLILPPSRTLVQTGTDDTARAFPVFTGYPSSGLCSSTISALRFSGGSRRKYSGLNLNRYGVASPCRTGLNLIHYILRPLQNSLPSRQLKP

SEQ ID NO: 6029 - DNA, 174 bp, Neisseria gonorrhoeae
ttgtcgaagacccgttatgtggtcgaacaaagcttcggtacgctgcaccgtaagttccgctatgcgcgggcagcctatttcggactgattaaagtgagtgcgcaaagccacctgaaggcgatgtgtttgaacctgttgaaagcggccaacaggctaagtgtgcccgctgccgcc

SEQ ID NO: 6030 - protein, 58 aa, Neisseria gonorrhoeae
LSKTRYVVEQSFGTLHRKFRYARAAYFGLIKVSAQSHLKAMCLNLLKAANRLSVPAAA

SEQ ID NO: 6031 - DNA, 381 bp, Neisseria gonorrhoeae
ttgcgcctccgtcagcgggcggttgcggcgggctttgcgcataatgccgtccagcagccgatgctctttcagttttccgtaggtcggattctcgaatccgacattacttcaatcgtattcaatagaaaagtccgcattgccgccaccccaattatgcggataaataccctgtttgacataacggtgaaacgtagaaaaccgccaatcggaaatttgtcctacatagccatgtttgaccggattgaaatgcagataatcaaaatggcaggcaaaatcggcctcaccgcggatagtatgttcccaaaagcgttttgccaaagcctgagattgccgccgattaaatattggctgtgccgcttgatttgccgccagcgttccgaa

SEQ ID NO: 6032 - protein, 127 aa, Neisseria gonorrhoeae
LRLRQRAVAAGFAHNAVQQPMLFQFSVGRILESDITSIVFNRKVRIAATPIMRINTLFDITVKRRKPPIGNLSYIAMFDRIEMQIIKMAGKIGLTADSMFPKAFCQSLRLPPIKYWLCRLICRQRSE

SEQ ID NO: 6033 - DNA, 210 bp, Neisseria gonorrhoeae
ttgctgaaccgtcattcccacggaagtgggaatctaggacgcggggtttgggcaaccgttttatccgataagtttccgtgcggacaggtccggatttccgcctgcgcgggaatgacgaatttcgagattgcggtgttgtcggacgggtttcgagattacggtattgtcgggaatgacggttcgggtatttccaagcccgccccgcgcctg

SEQ ID NO: 6034 - protein, 70 aa, Neisseria gonorrhoeae
LLNRHSHGSGNLGRGVWATVLSDKFPCGQVRISACAGMTNFEIAVLSDGFRDYGIVGNDGSGISKPAPRL

SEQ ID NO: 6035 - DNA, 381 bp, Neisseria gonorrhoeae
atgccgtctgaaccttcagacggcatttttaatcgcccgccgtttacaggcgcggggcgggcttggaaatacccgaaccgtcattcccgacaataccgtaatctcgaaacccgtccgacaacaccgcaatctcgaaattcgtcattcccgcgcaggcggaaatccggacctgtccgcacggaaacttatcggataaaacggttgcccaaaccccgcgtcctagattcccacttccgtgggaatgacggttcagcaagcgtaggccggatacttgtatccgacaaaacctttaacattcccatcattgcaatccattgcagcaatgtccaaaatgtcgaattcaagaatccggcctacaaaatcattccgagcataatacta

SEQ ID NO: 6036 - protein, 127 aa, Neisseria gonorrhoeae
MPSEPSDGIFNRPPFTGAGRAWKYPNRHSRQYRNLETRPTTPQSRNSSFPRRRKSGPVRTETYRIKRLPKPRVLDSHFRGNDGSASVGRILVSDKTFNIPIIAIHCSNVQNVEFKNPAYKIIPSIIL

SEQ ID NO: 6037 - DNA, 678 bp, Neisseria gonorrhoeae
gtgcaggcggatctggcttacgcctacgagcacatcacccgcgattatcccgatgcagccggtgcaaaccaaggcaaaaaaataagcacggtaagcgattatttcaaaaacatccgtacgcattccatccaccccagggtgtcggtcggctacgacttcggcggctggaggatagcggcagattatgcccgttacagaaagtggaacgacaataaatattccgtcgacataaaagagttggaaaacaagaatcagaataagagagacctgaagacggaaaatcaggaaaacggcagcttccacgccgtttcttctctcggcttatcagccgtttacgatttcaaactcaacgacaaattcaaaccctatatcggtgcgcgcgtcgcctacggacacgtcagacacagcatcgattcgaccaaaaaaacaacagagtttcttaccgccgccggtcaggatggcggagcgcctacggtttataataacggaagtacgcaagacgcccatcaagaaagcgacagcatccgccgcgtgggcctcggcgtcatcgccggtatcggtttcgacatcacgcccaagctgaccctggacaccggctaccgctaccacaactggggacgcttggaaaacacccgcttcaaaacccacgaagcctcattgggcgtgcgctaccgcttc

SEQ ID NO: 6038 - protein, 226 aa, Neisseria gonorrhoeae
VQADLAYAYEHITRDYPDAAGANQGKKISTVSDYFKNIRTHSIHPRVSVGYDFGGWRIAADYARYRKWNDNKYSVDIKELENKNQNKRDLKTENQENGSFHAVSSLGLSAVYDFKLNDKFKPYIGARVAYGHVRHSIDSTKKTTEFLTAAGQDGGAPTVYNNGSTQDAHQESDSIRRVGLGVIAGIGFDITPKLTLDTGYRYHNWGRLENTRFKTHEASLGVRYRF

SEQ ID NO: 6039 - DNA, 387 bp, Neisseria gonorrhoeae
atgaaaaacgttcaaaaaggctttacgctgctcgagctgatgattgccgtcgccatcctcggcatcctgacgctcatcgcctacccatcctataaaacctacatccggcgcgcccgcctgtcggaagtcaaatccaccctgctgatgaacgcgcaaaacttggagcgttactaccgccaaaaagggacgtttgaaaaatacgactcaaccaaactgaaacaaaacaaatatttcaagattaccttaatcaaagccagccccgaccacttcacccttcaggccgctcccgatacggcgaccaacgaaggcgaaacctgcaccgttacgctcaacgacggcggtaccattgccgcttccggtacaaaccaatcctgccccggcttcgac

SEQ ID NO: 6040 - protein, 129 aa, Neisseria gonorrhoeae
MKNVQKGFTLLELMIAVAILGILTLIAYPSYKTYIRRARLSEVKSTLLMNAQNLERYYRQKGTFEKYDSTKLKQNKYFKITLIKASPDHFTLQAAPDTATNEGETCTVTLNDGGTIAASGTNQSCPGFD

SEQ ID NO: 6041 - DNA, 90 bp, Neisseria gonorrhoeae
ttgttcatccgccatattgtgttgaaacaccgcccggaacccgatataatccgcccttcaacatcagtgaaaatcttttttttaaccggt

SEQ ID NO: 6042 - protein, 30 aa, Neisseria gonorrhoeae
LFIRHIVLKHRPEPDIIRPSTSVKIFFLTG

SEQ ID NO: 6043 - DNA, 150 bp, Neisseria gonorrhoeae
atggcggatgaacaaaaaccggtacgggttgccccgccccggctcaaagggaacggttccctaaggcgtccaagcaccgggcgaaccggttccgtaccatccgtactgcctgcggcccgccgccttgtcctgatttttgttaatccgcta

SEQ ID NO: 6044 - protein, 50 aa, Neisseria gonorrhoeae
MADEQKPVRVAPPRLKGNGSLRRPSTGRTGSVPSVLPAARRLVLIFVNPL

SEQ ID NO: 6045 - DNA, 744 bp, Neisseria gonorrhoeae
ttgcgctacggcttgggcgtgtcgcgcgaaatcaatgcgggcgggcatcatttcctctacggcggcatcagccgcggcgtgcattattgggataacaaagatttcagcgaacagagcctgcgcctgtcgttcggccatcaaaaccgttcggtaacgcgctcgttcggcaccgtgccgtttgtcgggcaaaacctcttgggcggcagccgatacaatttcgccggcggcttcaatgccgatttctcccgacgcttgggcgaacgctggcggctgacgctgaacgcgggcaatatgtggaagcattatcaggaagaccgcaccgccgcccgatacggcagccatatgccgctggcgggcgcgacgctgatgtattccgcgccgaaagaccggctgctttacggcggtgcggactggccgcacgacatgacgaaagaggcggaacaggcttccgtccgcaagggtttgcgtgtcggcgcggtcaaaacgttcgacggcggcttggggctgcgggcaaacctgcgctatacccgcaggacttttgatgcacccgggacaattgtgtaccgcttcccgcgcaaagaccacgaatatcaggcaaacctgtcgttgcggcacgacaaaatctcttggaagggctttacgccgcaactcaatttccgctatctgaaaatcggcagcaatatgaaaagtttttacacacgcaaaaatacgcagattttcatgagcgtggaaaaggatttcaaa

SEQ ID NO: 6046 - protein, 248 aa, Neisseria gonorrhoeae
LRYGLGVSREINAGGHHFLYGGISRGVHYWDNKDFSEQSLRLSFGHQNRSVTRSFGTVPFVGQNLLGGSRYNFAGGFNADFSRRLGERWRLTLNAGNMWKHYQEDRTAARYGSHMPLAGATLMYSAPKDRLLYGGADWPHDMTKEAEQASVRKGLRVGAVKTFDGGLGLRANLRYTRRTFDAPGTIVYRFPRKDHEYQANLSLRHDKISWKGFTPQLNFRYLKIGSNMKSFYTRKNTQIFMSVEKDFK

SEQ ID NO: 6047 - DNA, 999 bp, Neisseria gonorrhoeae
ttgcgcttatttgaaatccttttccacgctcatgaaaatctgcgtatttttgcgtgtgtaaaaacttttcatattgctgccgattttcagatagcggaaattgagttgcggcgtaaagcccttccaagagattttgtcgtgccgcaacgacaggtttgcctgatattcgtggtctttgcgcgggaagcggtacacaattgtcccgggtgcatcaaaagtcctgcgggtatagcgcaggtttgcccgcagccccaagccgccgtcgaacgttttgaccgcgccgacacgcaaacccttgcggacggaagcctgttccgcctctttcgtcatgtcgtgcggccagtccgcaccgccgtaaagcagccggtctttcggcgcggaatacatcagcgtcgcgcccgccagcggcatatggctgccgtatcgggcggcggtgcggtcttcctgataatgcttccacatattgcccgcgttcagcgtcagccgccagcgttcgcccaagcgtcgggagaaatcggcattgaagccgccggcgaaattgtatcggctgccgcccaagaggttttgcccgacaaacggcacggtgccgaacgagcgcgttaccgaacggttttgatggccgaacgacaggcgcaggctctgttcgctgaaatctttgttatcccaataatgcacgccgcggctgatgccgccgtagaggaaatgatgcccgcccgcattgatttcgcgcgacacgcccaagccgtagcgcaaaccgtgtgccttttgcggcaggctgtcggcggttttcgtccagcttctgcccgcaaattcaatcgttttttcggacgaagcgttgtttatagcggattaacaaaaatcaggacaaggcggcgggccgcaggcagtacggatggtacggaaccggttcgcccggtgcttggacgccttagggaaccgttccctttgagccggggcggggcaacccgtaccggtttttgttcatccgccatattgtgt

SEQ ID NO: 6048 - protein, 333 aa, Neisseria gonorrhoeae
LRLFEILFHAHENLRIFACVKTFHIAADFQIAEIELRRKALPRDFVVPQRQVCLIFVVFAREAVHNCPGCIKSPAGIAQVCPQPQAAVERFDRADTQTLADGSLFRLFRHVVRPVRTAVKQPVFRRGIHQRRARQRHMAAVSGGGAVFLIMLPHIARVQRQPPAFAQASGEIGIEAAGEIVSAAAQEVLPDKRHGAERARYRTVLMAERQAQALFAEIFVIPIMHAAADAAVEEMMPARIDFARHAQAVAQTVCLLRQAVGGFRPASARKFNRFFGRSVVYSGLTKIRTRRRAAGSTDGTEPVRPVLGRLREPFPLSRGGATRTGFCSSAILC

SEQ ID NO: 6049 - DNA, 120 bp, Neisseria gonorrhoeae
atgccgtccgaacgtttttcagacggcattttttgctgtcggaaacataccgtcggcaacatccgtgagcagaatcaaaaacagccgcatcatttattgtcaacgcctgcgccgtcagag

SEQ ID NO: 6050 - protein, 40 aa, Neisseria gonorrhoeae
MPSERFSDGIFCCRKHTVGNIREQNQKQPHHLLSTPAPSE

SEQ ID NO: 6051 - DNA, 111 bp, Neisseria gonorrhoeae
ttggaacccaaatcgacggaggcgaggatgtttgcgggattggtggtcatggcggataccggtgggggaaaaacgcaatgttactctgacggcgcaggcgttgacaataaa

SEQ ID NO: 6052 - protein, 37 aa, Neisseria gonorrhoeae
LEPKSTEARMFAGLVVMADTGGGKTQCYSDGAGVDNK

SEQ ID NO: 6053 - DNA, 1467 bp, Neisseria gonorrhoeae
ttgggttccaacagtttccgcctccagatttgcgaaagcaacaacggacaattaaaagtcatcgattccttcaaacagatggtccgttttgccgccggtctggacgaacagaaaaacctcagcacatcctcgcaggaacaggctttggactgcctggcaaaattcggcgaacgcctgcgcggcttccgccccgagcaggtgcgcgccgtggcaaccaatacattccgcgtcgccaaaaacatcgcagatttccttcccaaggccgaagcggcactgggtttccccatcgaaatcatcgccgggcgcgaagaggcgcggctgatttataccggcgtgatccacaccctccccccctgcgggggcaaaatgctggttatcgacatcggcggcggttcgacagaatttgtcatcggttcgacgctgaatcccgacattaccgaaagcctgcccttgggctgcgtaacctacagcctgcgcttcttccaaaacaaaatcaccgccaaagacttccaagccgccatttccgccgcccgcaacgaaatccagcgcatcagcaaaaatatgatgcgcgaaggttgggatttcgccgtcggcacatcgggttcggcaaaatccatccgcgacgtgcttgccgccgaaatgccccaagaggcggacattacctacaagggaatgcgcgccctcgccgaacgcatcatcgaagccggttcggtcaaaaaagccaaatttgaaaacctgaaaccggaacgcatcgaagtttttgccggcggacttgccgtgatgatggcggcgtttgaggaaatgaaactcgacaggatgaccgtaaccgaagccgccctgcgcgacggcgtgttttacgatttgatcgggcgcggcttaaacgaagatatgcgcggacaaacggttgccgagttccaacaccgctaccacgtcagcctcaatcaggcgaaacgcaccgccgagaccgcgcaaacctttatggacagcctctgtcatgccaaaaacgttacggttcaagaacttgccttgtggcaacagtatctcggacgcgccgccgcgctgcatgaaatcggtttggacatcgcccacaccggctatcacaagcattccgcctacatcctcgaaaacgccgatatgccgggtttttcacgcaaggaacagaccatacttgcccaactggtcatcggtcatcgcggcgatatgaaaaaaatgggcggcattatcggcggcaacgaaatgttgtggtatgccgttttgtccctgcgccttgccgccttgttctgccgttcgcgccaagacctgtctttcccgaaaaatatgcagttgcgtacggatacggaaagctgcggcttcatcctgcgtattgacagtaaatggctggaacgccaccccctgattgccgacgcattggaatatgaaagcgtccaatggcaaaaaatcaatatgccgttcaaagttgaagccgtc

SEQ ID NO: 6054 - protein, 489 aa, Neisseria gonorrhoeae
LGSNSFRLQICESNNGQLKVIDSFKQMVRFAAGLDEQKNLSTSSQEQALDCLAKFGERLRGFRPEQVRAVATNTFRVAKNIADFLPKAEAALGFPIEIIAGREEARLIYTGVIHTLPPCGGKMLVIDIGGGSTEFVIGSTLNPDITESLPLGCVTYSLRFFQNKITAKDFQAAISAARNEIQRISKNMMREGWDFAVGTSGSAKSIRDVLAAEMPQEADITYKGMRALAERIIEAGSVKKAKFENLKPERIEVFAGGLAVMMAAFEEMKLDRMTVTEAALRDGVFYDLIGRGLNEDMRGQTVAEFQHRYHVSLNQAKRTAETAQTFMDSLCHAKNVTVQELALWQQYLGRAAALHEIGLDIAHTGYHKHSAYILENADMPGFSRKEQTILAQLVIGHRGDMKKMGGIIGGNEMLWYAVLSLRLAALFCRSRQDLSFPKNMQLRTDTESCGFILRIDSKWLERHPLIADALEYESVQWQKINMPFKVEAV

SEQ ID NO: 6055 - DNA, 555 bp, Neisseria gonorrhoeae
atgccgtctgaagcccttcagacggcatttcgcggcaacatccgaaggagttttaccatgatccgtttgacccgcgcgtttgccgccgccctgatcggtttatgctgcaccacaggcgcgcacgccgacaccttccaaaaaatcggctttatcaacaccgagcgcatctacctcgaatccaagcaggcgcgcaacatccaaaaaacgctggacggcgaattttccgcccgtcaggacgaattgcaaaaactgcaacgcgaaggcttggatttggaaaggcagctcgccggcggcaaacttaaggacgcaaaaaaggcgcaagccgaagaaaaatggcgcgggctggtcgaagcgttccgcaaaaaacaggcgcagtttgaagaagactacaacctccgccgcaacgaagagtttgcctccctccagcaaaacgccaaccgcgtcatcgtcaaaatcgccaaacaggaaggttacgatgtcattttgcaggacgtgatttacgtcaacacccaatacgacgttaccgacagcgtcattaaagaaatgaacgcccgc

SEQ ID NO: 6056 - protein, 185 aa, Neisseria gonorrhoeae
MPSEALQTAFRGNIRRSFTMIRLTRAFAAALIGLCCTTGAHADTFQKIGFINTERIYLESKQARNIQKTLDGEFSARQDELQKLQREGLDLERQLAGGKLKDAKKAQAEEKWRGLVEAFRKKQAQFEEDYNLRRNEEFASLQQNANRVIVKIAKQEGYDVILQDVIYVNTQYDVTDSVIKEMNAR

SEQ ID NO: 6057 - DNA, 1062 bp, Neisseria gonorrhoeae
ttgaaaaggagcgcaatcatgaaaatgcaggcagttgttgtgaataaaaatgtagcgggcgatgtggaagtagtcgaacgcgaggttcgcccgttggaatacggcgaggcattggtcgaagtcgaatattgcggcgtgtgccataccgacctgcacgttgcggcaggcgactacggcgaaaaaccgggccgcgtgctgggacacgagggcatcggtttggttaaagaagttgccgacggtgtgaaaaatctgaaagtcggcgaccgcgtcagcatcgcctggctgttccaaagctgcggctcttgcgaatactgcaataccggccgcgaaaccctgtgccgttccgtattgaacgcgggctacaccgccgacggcggtatggcgacccactgcatcgtgagtgccgattacgcggtcaaagtccctgaaggtttggatcctgcgcaagcttccagcattacttgtgccggcgtgaccacttataaagccattaaagtttccggcgttcgtcctggtcaatggattgcgatttacggcgcgggcggcttgggcaacttgggtgtccaatacgcgaaaaaagtattcggcacgcacgttgtcgccatcgacatcaacgacgacaagctggcatttgccaaagaaaccggcgcggatttggttgtcaacgccgccaaagaggacgctgccaaagtgattcaggaaaaaaccggcggcgcacacgctgcggtcgtaaccgccgtatctgctgccgcattcaactctgccgtgaattgcgtccgcgcgggcggacgtgtggttgccgtcgggctgccgccggaatcgatggatttgtccatcccgcgtttggttttggacggcatcgaagtggtcggctctttggtcggcacgcgcaaagatttggaagaagccttccaattcggcgcggaaggtttggttgtgccgaaagtccaactgcgtgctttggatgaagcacccgccattttccaagaaatgcgcgaaggcaaaatcaccggccgtatggtgatcgatatgaaaaaagaatgcggctgcgatcatcaccac

SEQ ID NO: 6058 - protein, 354 aa, Neisseria gonorrhoeae
LKRSAIMKMQAVVVNKNVAGDVEVVEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSGVRPGQWIAIYGAGGLGNLGVQYAKKVFGTHVVAIDINDDKLAFAKETGADLVVNAAKEDAAKVIQEKTGGAHAAVVTAVSAAAFNSAVNCVRAGGRVVAVGLPPESMDLSIPRLVLDGIEVVGSLVGTRKDLEEAFQFGAEGLVVPKVQLRALDEAPAIFQEMREGKITGRMVIDMKKECGCDHHH

SEQ ID NO: 6059 - DNA, 909 bp, Neisseria gonorrhoeae
atggacaccctgttcagcctcaaagttttccgccaagtcgtccaaagcggcggcttcacccgcgccgccgacgcgctcggcatctccaccgcaatggcaagcaaacacgtcagtcacttggaaaacaccgtccaagccaaactcctgcaccacaacagccgcaacctcagcctgaccgaagccggggaagaatactaccggcaatgcagttacgcgctcgacacgctcgacgatgccgcgcaaaaagccgccggggggacggaaaaaccgcaggggctgctgcgcgtaacgatgccgctgtggtttgccggcagccagatatgcaactggctggcggaataccgcgaacgttatcccgaagtggcgttggaactgattttggacaaccgccacgtcgatttgattgccgaaggcgtggatttggcgttgcgcgtttcccaaaccctttccccttcgctgattgcgcgcccgctggcggaaatcgaatttgccctgcttgcctcgcccgacttcctgaggcgcaacggcgtgccggaaacaccggaagaagtggcggggctgcctgccgtcctgccgacctacaccaaccagcagaaactcgacctcacccgcaaatcggacggcaagaaataccggcttgaactgacccccgtcatccgtaccgacaacacgctgatgatgcgcgaaatgattaaggcgggcgcgtgcatcggttatcagccgctttgggcggcggaacacgatttgcgctgcggcccgctggtgaggctgctgcccggatacgccgtcccgaccgaccggctgaacgccgtttatgcggacagggcatttttgagtgcgaaagtccgcagtttcatcgattttctgaacgaaaaaatcgccagcaggaaaggctgccgaaatgccgtc

SEQ ID NO: 6060 - protein, 303 aa, Neisseria gonorrhoeae
MDTLFSLKVFRQVVQSGGFTRAADALGISTAMASKHVSHLENTVQAKLLHHNSRNLSLTEAGEEYYRQCSYALDTLDDAAQKAAGGTEKPQGLLRVTMPLWFAGSQICNWLAEYRERYPEVALELILDNRHVDLIAEGVDLALRVSQTLSPSLIARPLAEIEFALLASPDFLRRNGVPETPEEVAGLPAVLPTYTNQQKLDLTRKSDGKKYRLELTPVIRTDNTLMMREMIKAGACIGYQPLWAAEHDLRCGPLVRLLPGYAVPTDRLNAVYADRAFLSAKVRSFIDFLNEKIASRKGCRNAV

SEQ ID NO: 6061 - DNA, 558 bp, Neisseria gonorrhoeae
cattccgaatctgaacaggatcaaagcggcagcacccaaaaaaatcaaagcggaacaacccaaaccgcaaacggcgaaacccaaagccgaaactgcatccatgccgtctgaaccgtccaaacaggcaacggtagagaaaccgatagagaaacctgtcgaaaaaccggttgaaaaacctgaagcaaaagttgccgcgcccgaagcaaaagcggaaaaaccggccgttcgacccgaacccaaacccgcagtgtccgaaactccggcttcggcgacagaacgccaacccggacctgtacccgctgcaaatactgccgcatcggaaaccgctgccgaatccgcccccccaagaagccgccgcttctgccatcgacacgccgaccgacgaaaccggtaacaccgtttccgaacctgttgcggaaacagccagtgaagttgccgccgaacccgttgccgaacctgtcgaacaggtttctgccgaagaagaaaccgaaagcggactgtttgacggtctgttcggcggttcgtacaccttgctgcttgccggcggaggcacggcat

SEQ ID NO: 6062 - protein, 36 aa, Neisseria gonorrhoeae
HSESEQDQSGSTQKNQSGTTQTANGETQSRNCIHAV

SEQ ID NO: 6063 - DNA, 1116 bp, Neisseria gonorrhoeae; identical to SEQ ID NO: 107

SEQ ID NO: 6064 - protein, 372 aa, Neisseria gonorrhoeae; identical to SEQ ID NO: 108

SEQ ID NO: 6065 - DNA, 381 bp, Neisseria gonorrhoeae
ttgggttgccggcaggcggcatctcgtcatttttgccaaggcaacaaattatttggcggcgtctttcattttgtctgccgcttcctgagccgcgtcggcagctttgttcaaagtgtctttagccgcttcgcttaccgcttctttggtttcggctgccgcgtctttggcttcagttacagcttcctcggcacttgcctttgcatcagccgcagcatctttgacttggcctttcgcttcttcgacggcagaagcggcagactcggcggcagaagccgcagtgtctttaacatcggactcaacggcttgggccgcttctttaacctcctgtttggcttcttgcgaacaagctgccaaggcagccgccatcattgcggcaatcaa

SEQ ID NO: 6066 - protein, 127 aa, Neisseria gonorrhoeae
LGCRQAASRHFCQGNKLFGGVFHFVCRFLSRVGSFVQSVFSRFAYRFFGFGCRVFGFSYSFLGTCLCISRSIFDLAFRFFDGRSGRLGGRSRSVFNIGLNGLGRFFNLLFGFLRTSCQGSRHHCGNQ

SEQ ID NO: 6067 - DNA, 342 bp, Neisseria gonorrhoeae
atgaaaaaattattgattgccgcaatgatggcggctgccttggcagcttgttcgcaagaagccaaacaggaggttaaagaagcggcccaagccgttgagtccgatgttaaagacactgcggcttctgccgccgagtctgccgcttctgccgtcgaagaagcgaaaggccaagtcaaagatgctgcggctgatgcaaaggcaagtgccgaggaagctgtaactgaagccaaagacgcggcagccgaaaccaaagaagcggtaagcgaagcggctaaagacactttgaacaaagctgccgacgcggctcaggaagcggcagacaaaatgaaagacgccgccaaa

SEQ ID NO: 6068 - protein, 114 aa, Neisseria gonorrhoeae
MKKLLIAAMMAAALAACSQEAKQEVKEAAQAVESDVKDTAASAAESAASAVEEAKGQVKDAAADAKASAEEAVTEAKDAAAETKEAVSEAAKDTLNKAADAAQEAADKMKDAAK

SEQ ID NO: 6069 - DNA, 132 bp, Neisseria gonorrhoeae
ttgcggcaatcaataattttttcatgtcttatccttcttgagttgttgattaaggttttgcttaaaaaccggaccgtgttccatcaatcggctgattttgcccatcggccggagagaaaacggtttcccgtt

SEQ ID NO: 6070 - protein, 44 aa, Neisseria gonorrhoeae
LRQSIIFSCLILLELLIKVLLKNRTVFHQSADFAHRPERKRFPV

SEQ ID NO: 6071 - DNA, 90 bp, Neisseria gonorrhoeae
ttggatttttcaaaccttgcggaaaaagtccgcgccgccgggaaactcaaaaggaggggatgtgtgttacaattttccgaactgttttca

SEQ ID NO: 6072 - protein, 30 aa, Neisseria gonorrhoeae
LDFSNLAEKVRAAGKLKRRGCVLQFSELFS

SEQ ID NO: 6073 - DNA, 543 bp, Neisseria gonorrhoeae
atgctgaaaataccttttgccgtgttgggcggctgcctgctgcttgccgcctgcggcaaatccgaaaatacggcggaacagccgcaaaatgcggcacaaagcgcgccgaaaccggttttcaaagtcaaatacatcgacaatacggcgattgccggtttggctttgggacaaagtagcgaaggcaaaaccaacgacggcaaaaaacaaatcagttatccgattaaaggcttgccggaacaaaacgccgtccggctgaccggaaagcatcccaacgacttggaagccgtcgtcggcaaatgtatggaaaccgacggaaaggacgcgccttcgggctgggcggaaaacggcgtgtgccataccttgtttgccaaactggtgggcaatatcgccgaagacggcggcaaactgactgattacctgatttcgcattccgccctgcaaccctatcaggcaggcaaaagcggctatgccgccgtgcagaacggacgctatgtgctggaaatcgacagcgagggggcgttttatttccgccgccgccattat

SEQ ID NO: 6074 - protein, 181 aa, Neisseria gonorrhoeae
MLKIPFAVLGGCLLLAACGKSENTAEQPQNAAQSAPKPVFKVKYIDNTAIAGLALGQSSEGKTNDGKKQISYPIKGLPEQNAVRLTGKHPNDLEAVVGKCMETDGKDAPSGWAENGVCHTLFAKLVGNIAEDGGKLTDYLISHSALQPYQAGKSGYAAVQNGRYVLEIDSEGAFYFRRRHY

SEQ ID NO: 6075 - DNA, 411 bp, Neisseria gonorrhoeae
tgctgcaccacaggcgcgcacgccgacaccttccaaaaaatcggctttatcaacaccgagcgcatctacctcgaatccaagcaggcgcgcaacatccaaaaaacgctggacggcgaattttccgcccgtcaggacgaattgcaaaaactgcaacgcgaaggcttggatttggaaaggcagctcgccggcggcaaacttaaggacgcaaaaaaggcgcaagccgaagaaaaatggcgcgggctggtcgaagcgttccgcaaaaaacaggcgcagtttgaagaagactacaacctccgccgcaacgaagagtttgcctccctccagcaaaacgccaaccgcgtcatcgtcaaaatcgccaaacaggaaggttacgatgtcattttgcaggacgtgatttacgtcaacacccaa

SEQ ID NO: 6076 - protein, 137 aa, Neisseria gonorrhoeae
CCTTGAHADTFQKIGFINTERIYLESKQARNIQKTLDGEFSARQDELQKLQREGLDLERQLAGGKLKDAKKAQAEEKWRGLVEAFRKKQAQFEEDYNLRRNEEFASLQQNANRVIVKIAKQEGYDVILQDVIYVNTQ

SEQ ID NO: 6077 - DNA, 1482 bp, Neisseria gonorrhoeae
gtgtaccgccacgtcaaatcagtggtgatgatcgcagccgcattcttttttcatatcgatcaccatacggccggtgattttgccttcgcgcatttcttggaaaatggcgggtgcttcatccaaagcacgcagttggactttcggcacaaccaaaccttccgcgccgaattggaaggcttcttccaaatctttgcgcgtgccgaccaaagagccgaccacttcgatgccgtccaaaaccaaacgcgggatggacaaatccatcgattccggcggcagcccgacggcaaccacacgtccgcccgcgcggacgcaattcacggcagagttgaatgcggcagcagatacggcggttacgaccgcagcgtgtgcgccgccggttttttcctgaatcactttggcagcgtcctctttggcggcgttgacaaccaaatccgcgccggtttctttggcaaatgccagcttgtcgtcgttgatgtcgatggcgacaacgtgcgtgccgaatacttttttcgcgtattggacacccaagttgcccaagccgcccgcgccgtaaatcgcaatccattgaccaggacgaacgccggaaactttaatggctttataagtggtcacgccggcacaagtaatgctggaagcttgcgcaggatccaaaccttcagggactttgaccgcgtaatcggcactcacgatgcagtgggtcgccataccgccgtcggcggtgtagcccgcgttcaatacggaacggcacagggtttcgcggccggtattgcagtattcgcaagagccgcagctttggaacagccaggcgatgctgacgcggtcgccgactttcagatttttcacaccgtcggcaacttctttaaccaaaccgatgccctcgtgtcccagcacgcggcccggtttttcgccgtagtcgcctgccgcaacgtgcaggtcggtatggcacacgccgcaatattcgacttcgaccaatgcctcgccgtattccaacgggcgaacctcgcgttcgactacttccacatcgcccgctacatttttattcacaacaactgcctgcattttcatgattgcgctccttttcaaggtaaaaaacctgtaaacggaatgttgtccgatataagggtaagtatacgcttccgcatcttgagggtcaaatggtatgttgttgaaaaatatatgttatattataacagttggggaggcgcggcattggacggcggccggatgcgggggcggcaggtttcaagtttgaaaaaacggaggggcaaacccgtaaaaatgccgtctgaagctgtgtccggacggcatttttacgggtttgcgggcttcggcggaggattagtcgaagccggggcaggattggtttgtaccggaagcggcaatggtaccgccgtcgttgagcgtaacggtgcaggtttcgccttcgttggtcgccgtatcgggagcggcctgaagggtgaagtggtcggggctggctttgat

SEQ ID NO: 6078 - protein, 494 aa, Neisseria gonorrhoeae
VYRHVKSVVMIAAAFFFHIDHHTAGDFAFAHFLENGGCFIQSTQLDFRHNQTFRAELEGFFQIFARADQRADHFDAVQNQTRDGQIHRFRRQPDGNHTSARADAIHGRVECGSRYGGYDRSVCAAGFFLNHFGSVLFGGVDNQIRAGFFGKCQLVVVDVDGDNVRAEYFFRVLDTQVAQAARAVNRNPLTRTNAGNFNGFISGHAGTSNAGSLRRIQTFRDFDRVIGTHDAVGRHTAVGGVARVQYGTAQGFAAGIAVFARAAALEQPGDADAVADFQIFHTVGNFFNQTDALVSQHAARFFAVVACRNVQVGMAHAAIFDFDQCLAVFQRANLAFDYFHIARYIFIHNNCLHFHDCAPFQGKKPVNGMLSDIRVSIRFRILRVKWYVVEKYMLYYNSWGGAALDGGRMRGRQVSSLKKRRGKPVKMPSEAVSGRHFYGFAGFGGGLVEAGAGLVCTGSGNGTAVVERNGAGFAFVGRRIGSGLKGEVVGAGFD

SEQ ID NO: 6079 - DNA, 1008 bp, Neisseria gonorrhoeae
atgagcaaaaaacgagttctgaccggcgtaaccaccaccggcaccccgcatctgggcaactacgtcggcgccatccgccccgccgtccgcgcggcgcaaaaccccgataccgaatccttcctcttcctcgccgattaccacggcatcatcaaatgccacgagcaggagatgattcaccaatccacccaagccgttgccgccacttggcttgcctgcggactcgaccccgagcgcaccaccttctaccgccaaagcgacattcccgaagtgatggagttgaactggattctgacctgcatcaccgccaagggtttgatgaaccgcgcccacgcctacaaagccgccgttcaagccaatgcggaaaacgggcaggaagaccccgatttcggtgtggaaatgggtttgttcagttatccgattctgatgactgccgacattttgatgttcaacgccaacgaagtccccgtcgggcgcgaccaaatccaacacgtcgaaatggcgcgcgacattgccggccgcttcaaccaccgtttccaagaactcttcaccctgcccgaagtgaaaatcgacgaaaacgtcgaactcttggtcggtttggacggacgcaaaatgtccaaatcctacggcaataccattccgctttgggaaaacgacaaaaaaacccaaaaatcggtcaacaaaatcattaccaacatgaaagagccgggcgagccgaaacagcccgacgaaagccctttgtttgaaatctataaagccttctccacgccgtctgaaacggcggaatttacgcaaatgcttgccgacggcttggcttggggcgaggcgaaaaaactttcggcggcgaaaatcaacgccgaattggcagaactgcgcgaacgctacaacgcattgacctctaatccttcgcaaatcgaagagattttgcaggcaggcgcgcaaaaagcgcgcaaagaagcgcgcgaattgttggataaagtacgcgatgcggtcggcatccgcccgttgaaa

SEQ ID NO: 6080 - protein, 336 aa, Neisseria gonorrhoeae
MSKKRVLTGVTTTGTPHLGNYVGAIRPAVRAAQNPDTESFLFLADYHGIIKCHEQEMIHQSTQAVAATWLACGLDPERTTFYRQSDIPEVMELNWILTCITAKGLMNRAHAYKAAVQANAENGQEDPDFGVEMGLFSYPILMTADILMFNANEVPVGRDQIQHVEMARDIAGRFNHRFQELFTLPEVKIDENVELLVGLDGRKMSKSYGNTIPLWENDKKTQKSVNKIITNMKEPGEPKQPDESPLFEIYKAFSTPSETAEFTQMLADGLAWGEAKKLSAAKINAELAELRERYNALTSNPSQIEEILQAGAQKARKEARELLDKVRDAVGIRPLK

SEQ ID NO: 6081 - DNA, 1179 bp, Neisseria gonorrhoeae
atgccgtctgaaatgccgtctgaaacgtggcaggcggaggttcggacggcattgggtttatttcaacgggcggatgccgaccgcatcgcgtactttatccaacaattcgcgcgcttctttgcgcgctttttgcgcgcctgcctgcaaaatctcttcgatttgcgaaggattagaggtcaatgcgttgtagcgttcgcgcagttctgccaattcggcgttgattttcgccgccgaaagttttttcgcctcgccccaagccaagccgtcggcaagcatttgcgtaaattccgccgtttcagacggcgtggagaaggctttatagatttcaaacaaagggctttcgtcgggctgtttcggctcgcccggctctttcatgttggtaatgattttgttgaccgatttttgggtttttttgtcgttttcccaaagcggaatggtattgccgtaggatttggacattttgcgtccgtccaaaccgaccaagagttcgacgttttcgtcgattttcacttcgggcagggtgaagagttcttggaaacggtggttgaagcggccggcaatgtcgcgcgccatttcgacgtgttggatttggtcgcgcccgacggggacttcgttggcgttgaacatcaaaatgtcggcagtcatcagaatcggataactgaacaaacccatttccacaccgaaatcggggtcttcctgcccgttttccgcattggcttgaacggcggctttgtaggcgtgggcgcggttcatcaaacccttggcggtgatgcaggtcagaatccagttcaactccatcacttcgggaatgtcgctttggcggtagaaggtggtgcgctcggggtcgagtccgcaggcaagccaagtggcggcaacggcttgggtggattggtgaatcatctcctgctcgtggcatttgatgatgccgtggtaatcggcgaggaagaggaaggattcggtatcggggttttgcgccgcgcggacggcggggcggatggcgccgacgtagttgcccagatgcggggtgccggtggtggttacgccggtcagaactcgttttttgctcataaaaatgtccttacggcagcaatgccgtctgaaagggaaaagatgcgccgattatacccgatttgccacatacatccagccgacaacagacttttccatattaagaagata

SEQ ID NO: 6082 - protein, 393 aa, Neisseria gonorrhoeae
MPSEMPSETWQAEVRTALGLFQRADADRIAYFIQQFARFFARFLRACLQNLFDLRRIRGQCVVAFAQFCQFGVDFRRRKFFRLAPSQAVGKHLRKFRRFRRRGEGFIDFKQRAFVGLFRLARLFHVGNDFVDRFLGFFVVFPKRNGIAVGFGHFASVQTDQEFDVFVDFHFGQGEEFLETVVEAAGNVARHFDVLDLVAPDGDFVGVEHQNVGSHQNRITEQTHFHTEIGVFLPVFRIGLNGGFVGVGAVHQTLGGDAGQNPVQLHHFGNVALAVEGGALGVESAGKPSGGNGLGGLVNHLLLVAFDDAVVIGEEEEGFGIGVLRRADGGADGADVVAQMRGAGGGYAGQNSFFAHKNVLTAAMPSEREKMRRLYPICHIHPADNRLFHIKKI

SEQ ID NO: 6083 - DNA, 2577 bp, Neisseria gonorrhoeae
atgcgatacgacaaattaaccgccaaattccaacaagcccttgcagaagctcagagtttggcgttggctgcggacagcagctatctggaagcaggtttcgtactgaaagccctgcttgacgaccaaaacagcggagctgccgcgctcttggctcatgcgggcgtgaacgtgccgcaggttaaacagcgtttgcagcagcatttgaacagcctgccgaaagtgtccggacaaggtggtgagattctgcccagccgcgaattgcaggcggtgttgaacctgatggacaaagcggcaaccaaacgcggcgatgcctatatcgccagcgaacttttcctgctcgccttggtgcagcagaacgatgcggccggcaaaatcttgaaagaagccggtgcgaccgaacaaaatatcaatgccgcgatcgatgcggtacgaggcggacaaaacgtgaacgatgcgaatgccgaagaccaacgcgatgctttgaaaaaatacacgctcgatctgacccaacgcgcccgagacggtaagctcgaccccgttatcggtcgtgatgatgaaatccgtcgcgcgattcaggtgctgcaacgccgcaccaaaaacaaccccgtgctgattggcgaacccggtgtgggtaaaaccgccatcgtcgaaggtttggcgcaacgcatcgtcaacggcgaagtacctgaatccctgcgtaacaaacgcctgctggttttggatttggcggctttgattgccggtgcgaaataccgtggcgaatttgaagaacgcttgaaaggcgtattgaacgatttggcgaaagacgacggcaacaccctgattttcatcgatgaaatccatactttggtcggcgcgggcaaaaccgacggcgcgatggacgcgggcaatatgttgaaaccggccttggcgcggggcgaactgcactgtatcggtgcgactactttggacgaataccgccaatacatcgaaaaagacgcggcactcgaacgccgtttccaaaaagtattggttggcgaacccagcgtggaagacaccatcgctatcctgcgcggtttgcaggaacgttacgaaatccaccacggcatcgatattaccgaccctgctatcgttgccgcagcggagttgagcgaccgctacattaccgaccgcttcctgcccgacaaggcgattgatttgattgacgaagctgccagccgtgtcaagatggaaaaagaaaccaaaccggaagctatggacaaaatcgaccgccgtttgattcagcttcggatggaaaaggcgcacgttgaaaaagaaaaagacgatgccagcaaaaaacgtttggaactgatagacgaggaaatcgacggcttgcaaaaagaatacgccgatttggacgaaatctggaaagccgaaaaagcgatttcagacggtgctgccaatattaagaaacaaattgacgaagtcaaaattaaaatcgaacaggcaaaacggcaaggcgatttggcactggcttcaaaattgatgtatgaagatttggagcatttggaaaaacagcgtgcagccgccgaacgggcagatacggacagcacaaaaccggcaaacaaactcttgcgtaataatgtcggcgcggaggaaatcgcagaagtggtttcccgtatgaccggcatccccgtgtcaaaaatgatggaaggcgaacgcgacaaactgctaaagatggaagaagtattgcaccgccgcgtagtcggtcaaaacgaagccgtgcgcgccgtgtccgatgccatccgccgcagccgctccggccttgccgatccgaacaaaccttacggcagcttcctgttcttaggcccgaccggtgtgggtaagaccgagttgtgcaaagctttggcaggcttcctgttcgacagcgaagaccacctcatccgcatcgacatgtccgaatacatggaaaaacacgccgttgcccgcttaatcggcgcgcctccgggttatgtcggatacgaagagggcggctacctgaccgaacaagtccgccgcaaaccgtacagcgtgattcttttggacgaagtggaaaaagcccatcccgacgtattcaacatcctgctgcaagtattggatgacggtcgtttgaccgacggacaaggcaggacggtagattttaaaaataccgtgattgtgatgacttccaacatcggcagccagcacatccaacaaatgggcacgcaggactacgaagcggtgaaagaagttgtgatggaggatgtgaaagaacatttccgtccggaaatgatcaaccgcatcgacgaagtggtcgtgttccatggcttggatcaggccaatatccgcagtattgcgaaaatccagctcaaaggtttggaaaaacgtttggaaaaacaaaacctgcgcctgactgtttccgatgccgctctggacatcatcgccaaagccggtttcgacccgatttacggcgcacgtccgctcaaacgcgcgatccaatcggaaatcgaaaacccgctggccaaagccctgcttgccggaaactatgcgcccgaaagcgaaatcaaggtagaagccgacggcgacagactgaaatttgcc

SEQ ID NO: 6084 - protein, 859 aa, Neisseria gonorrhoeae
MRYDKLTAKFQQALAEAQSLALAADSSYLEAGFVLKALLDDQNSGAAALLAHAGVNVPQVKQRLQQHLNSLPKVSGQGGEILPSRELQAVLNLMDKAATKRGDAYIASELFLLALVQQNDAAGKILKEAGATEQNINAAIDAVRGGQNVNDANAEDQRDALKKYTLDLTQRARDGKLDPVIGRDDEIRRAIQVLQRRTKNNPVLIGEPGVGKTAIVEGLAQRIVNGEVPESLRNKRLLVLDLAALIAGAKYRGEFEERLKGVLNDLAKDDGNTLIFIDEIHTLVGAGKTDGAMDAGNMLKPALARGELHCIGATTLDEYRQYIEKDAALERRFQKVLVGEPSVEDTIAILRGLQERYEIHHGIDITDPAIVAAAELSDRYITDRFLPDKAIDLIDEAASRVKMEKETKPEAMDKIDRRLIQLRMEKAHVEKEKDDASKKRLELIDEEIDGLQKEYADLDEIWKAEKAISDGAANIKKQIDEVKIKIEQAKRQGDLALASKLMYEDLEHLEKQRAAAERADTDSTKPANKLLRNNVGAEEIAEVVSRMTGIPVSKMMEGERDKLLKMEEVLHRRVVGQNEAVRAVSDAIRRSRSGLADPNKPYGSFLFLGPTGVGKTELCKALAGFLFDSEDHLIRIDMSEYMEKHAVARLIGAPPGYVGYEEGGYLTEQVRRKPYSVILLDEVEKAHPDVFNILLQVLDDGRLTDGQGRTVDFKNTVIVMTSNIGSQHIQQMGTQDYEAVKEVVMEDVKEHFRPEMINRIDEVVVFHGLDQANIRSIAKIQLKGLEKRLEKQNLRLTVSDAALDIIAKAGFDPIYGARPLKRAIQSEIENPLAKALLAGNYAPESEIKVEADGDRLKFA

SEQ ID NO: 6085 - DNA, 1212 bp, Neisseria gonorrhoeae
atggataaatttcccaagtctgcaaagctcgaccacgtctgctacgacatacgcgggccggttcacaaaaaagcccttcagttggaagaggagggcaacaaaatcctcaagctcaatatcggcaaccctgcgccgttcggctttgaagcacctgatgaaatcttagtcgatgtcatccgcaacctgccgacttcgcaaggttattgcgattcgaaggggttgtattccgcacgcaaagccattgttcactactatcagaacaaaggtttgcgcgatattacggtaaacgatgtctatatcggcaacggcgtgtccgagctgattgcgatgtctatgcaggcgttgctcaacgacggcgacgaaatcctgattcccgcgcccgactaccctttgtggacggcggcggcaacgcttgcgggcggtacggtacgccattatctgtgcgacgaagaaaacggctggtttcccaaccttgccgatatggaagccaaaatcacgtccaaaaccaaagccatcgtcgtcatcaaccccaataacccgacaggagcggtgtacagcaaggaaatcctgctggaaattgccgaactggcgcgcaagcatggtttgattattttcgccgacgagatttacgacaaaatcctttatgatggcgcggttcactaccacatcgccgcgctcgcccccgaccttttgacggtaacgttcaacggtttgtccaaagcctaccgtgtagccgggttccgccaaggctggatggtgctaaacgggccgaaacatcacgcaaaaggttatatcgagggtttggatatgctctcgtccatgcgcttgtgtgccaatacgccgatgcagcacgcgattcagacggcattgggcggttatcagagcattaacgaattcatcttgcccggcggacggcttttggaacagcgcaacagagcgtgggaactggtcaaccagattcccggcgtgtcctgcgtcaaaccgatgggcgcgatgtatatgttcccgaaaatcgataccgaaatgtaccgcatccgcgatgatatgaaattcgtttacgatttgctggtgcgcgaaaaagtcctgctggtacagggaacggggtttaattggatcaaacccgaccatttccgcattgttacgctgccttacgtccatcagattgaagaggcgatgggcaggttggcaagattcctgcaaacctaccatcag

SEQ ID NO: 6086 - protein, 404 aa, Neisseria gonorrhoeae
MDKFPKSAKLDHVCYDIRGPVHKKALQLEEEGNKILKLNIGNPAPFGFEAPDEILVDVIRNLPTSQGYCDSKGLYSARKAIVHYYQNKGLRDITVNDVYIGNGVSELIAMSMQALLNDGDEILIPAPDYPLWTAAATLAGGTVRHYLCDEENGWFPNLADMEAKITSKTKAIVVINPNNPTGAVYSKEILLEIAELARKHGLIIFADEIYDKILYDGAVHYHIAALAPDLLTVTFNGLSKAYRVAGFRQGWMVLNGPKHHAKGYIEGLDMLSSMRLCANTPMQHAIQTALGGYQSINEFILPGGRLLEQRNRAWELVNQIPGVSCVKPMGAMYMFPKIDTEMYRIRDDMKFVYDLLVREKVLLVQGTGFNWIKPDHFRIVTLPYVHQIEEAMGRLARFLQTYHQ

SEQ ID NO: 6087 - DNA, 273 bp, Neisseria gonorrhoeae
ttgggcaatgggtgggaatgtactctttttcacgcgaaatttaaagcatcagggcggggttttcaggctttttacctgccctctttgcgccgttcgctgacgcttttgccgcctatatcccagttatcggtatccacttcgtcaatcacgacaaccgttgtttcgggatttttacccagcacgcgtgccagcaattcgattacgccgccgatcagttccgctttttgcgcggcagtcggtgcttccttgccgccggttactttaatattgaca

SEQ ID NO: 6088 - protein, 91 aa, Neisseria gonorrhoeae
LGNGWECTLFHAKFKASGRGFQAFYLPSLRRSLTLLPPISQLSVSTSSITTTVVSGFLPSTRASNSITPPISSAFCAAVGASLPPVTLILT

SEQ ID NO: 6089 - DNA, 207 bp, Neisseria gonorrhoeae
atgccttatgtcaatattaaagtaaccggcggcaaggaagcaccgactgccgcgcaaaaagcggaactgatcggcggcgtaatcgaattgctggcacgcgtgctgggtaaaaatcccgaaacaacggttgtcgtgattgacgaagtggataccgataactgggatataggcggcaaaagcgtcagcgaacggcgcaaagagggcagg

SEQ ID NO: 6090 - protein, 69 aa, Neisseria gonorrhoeae
MPYVNIKVTGGKEAPTAAQKAELIGGVIELLARVLGKNPETTVVVIDEVDTDNWDIGGKSVSERRKEGR

SEQ ID NO: 6091 - DNA, 1041 bp, Neisseria gonorrhoeae
atgattccggccacctgcaccctgtcccaaatcaccgcgcggctcggcggcgaatggcgcggcgaggacatttccgttaccgccgtgcgcccgctcgcagacgcgcaggcggaacacatcagcttcctcgccaatccgaaatacaaagccgaagtccacgacagcagcgcgggcgcgatcatcgtttccgccaaagcagcagacggatttgaagggcgcaacctgattgtcgccgacgatccctatctctatttcgccaaagtcgcgcgcctgttttcacccgtcgtcaaagcgcgcggcggcatccatccgaccgccgtcgtcgaaccgggcgcgaccgttcccgcaagctgtgaaatcggcgcgaacgcctacatcggcgcgaacaccgtgctcggcgaaggctgccgcatcttggcaaacgccgtcgtccaacacgattgcaaactgggcgacgaagtcgtcctgcatcccaacgccgtcgtttattacggctgcacactcggcagacacgtcgaaatccacagcggcgcggtcatcggcgcggacggtttcggactcgccttcgccggcgattcgtggttcaaaatcccgcaaaccggcgcggtaacgctgggcgacgacgtagaaatcggctcgaacaccaacatcgaccgcggcgcgatgagcgacaccaccgtcggcaacggcaccaaaatcgacaaccaagtccaaatcggacacaactgcaaaatcggttcgcacaccgtcatcgccgccaaaaccggcatctcaggcagcgtaaccataggcagctactgcatcatcggcggcggcgtcggtacggtcggacacatcgaaatcgccgacaaaaccaccatcggcggcggcacgtccgttacccacagcattaccgaaagcggcaaacaccttgccggcatcttcccgatgtccgagcataaagaatgggcgcgcaacgccgtttacatccaccgcttaagcgaaatgaacaaacgcctcaaaacgctggaacagcagctttcagacagcaaagacacgcaa

SEQ ID NO: 6092 - protein, 347 aa, Neisseria gonorrhoeae
MIPATCTLSQITARLGGEWRGEDISVTAVRPLADAQAEHISFLANPKYKAEVHDSSAGAIIVSAKAADGFEGRNLIVADDPYLYFAKVARLFSPVVKARGGIHPTAVVEPGATVPASCEIGANAYIGANTVLGEGCRILANAVVQHDCKLGDEVVLHPNAVVYYGCTLGRHVEIHSGAVIGADGFGLAFAGDSWFKIPQTGAVTLGDDVEIGSNTNIDRGAMSDTTVGNGTKIDNQVQIGHNCKIGSHTVIAAKTGISGSVTIGSYCIIGGGVGTVGHIEIADKTTIGGGTSVTHSITESGKHLAGIFPMSEHKEWARNAVYIHRLSEMNKRLKTLEQQLSDSKDTQ

SEQ ID NO: 6093 - DNA, 192 bp, Neisseria gonorrhoeae
atgccgtctgaacgctgttcagacggcattttttatggatttggatttgattttaatctgttctgtttgaaataccgtctgaaaacccttatcgcaacacttcattacagtggattaacaaaaatcaggacaaggcggcgagccgcagacagtacaaatagtacggcaaggcgagccaacgctgtaccgatt

SEQ ID NO: 6094 - protein, 64 aa, Neisseria gonorrhoeae
MPSERCSDGIFYGFGFDFNLFCLKYRLKTLIATLHYSGLTKIRTRRRAADSTNSTARRANAVPI

SEQ ID NO: 6095 - DNA, 138 bp, Neisseria gonorrhoeae
ttgaaatattgctatcttatcaaacaagttgcctccgcccaaacgtccgcttcattttctgaaaaattcaaatcgatacaaaaagacagttttcaggcggcaaatccgtcttcacacgatacatattttgttatagca

SEQ ID NO: 6096 - protein, 46 aa, Neisseria gonorrhoeae
LKYCYLIKQVASAQTSASFSEKFKSIQKDSFQAANPSSHDTYFVIA

SEQ ID NO: 6097 - DNA, 804 bp, Neisseria gonorrhoeae
atgaagaaaacattgacactgctcgccgtttccgcactatttgccacatccgcacacccccaccgcgtctgggtcgaaaccgcccacacgcacggcggcgaataccttaaagccgacttgggctacggcgaattccccgaactcgaacccatcgccaaagaccgcctgcacatcttcagcaaaccgatgcagctggttaccgaaaaaggtaaggaaaacatgattcaacgcggcacatacaactaccaataccgcagcaaccgtcccgtcaaagacggcagctacctcgttaccgccgaatatcagcctactttccggtcaaaaaacaaagcaggctggaaacaggctggcatcaaagaaatgcctgacgcaagctattgcgaacaaacccgtatgttcggtaaaaacattgtcaacgtgggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgctacatttgacggcttcgacaccagcgaccgcagcaaaacgcacaaaaccgaagcccaagccttctccgacaccaccgacggcaaaggcgaagtggacatcatccccttgcgccaaggcttttggaaagcgagtgtcgaatacaaagccgatttccccgatcaaagcctgtgccaaaaacaggcgaactacacaactttaaccttccaaatcggccattctcaccat

SEQ ID NO: 6098 - protein, 268 aa, Neisseria gonorrhoeae
MKKTLTLLAVSALFATSAHPHRVWVETAHTHGGEYLKADLGYGEFPELEPIAKDRLHIFSKPMQLVTEKGKENMIQRGTYNYQYRSNRPVKDGSYLVTAEYQPTFRSKNKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHKTEAQAFSDTTDGKGEVDIIPLRQGFWKASVEYKADFPDQSLCQKQANYTTLTFQIGHSHH

SEQ ID NO: 6099 - DNA, 93 bp, Neisseria gonorrhoeae
ttgatgtttgaacaaaggatgccgtctgaaaccatttcagacggcatttttgtttggacggaattaatggtgagaatggccgatttggaaggt

SEQ ID NO: 6100 - protein, 31 aa, Neisseria gonorrhoeae
LMFEQRMPSETISDGIFVWTELMVRMADLEG

SEQ ID NO: 6101 - DNA, 789 bp, Neisseria gonorrhoeae
atgtcgtggatggtggatgcctatgaaaacgtggtgaaacattccgcgccgggcgtatttaccggcaaaccggttgagttcggcggctctttggcgcgtaccgaggctaccggttacggcgtgaacctcgccgccgtccaagctttggaaaaactgggcaaagatgtgaaaggcgcaacctacgccattcaaggtttcggcaatgtgggctaccacaccggctattacgcgcatcaatccggcgcgaaagtcgttaccgtatctactgttgacgttgctatctacaatgaaaacggcttggatatggaagcgctgtttaaagagttccaagaaaaaggcttcatcaccaacaaagccggttacggcaaagaaattaccaacgccgaacttttggctttggatatggacgtactcgccccttgcgcattggaaaaccagctgacttccgaaaacgccggtaaagtccgcgcgaaaatcgtggttgaaggcgcaaacggcccgactacgcccgaagccgacgttatcctgcatcaaaacggcgtattggtcgtgcccgatattttggcaaactgcggcggcgtggtcgtttcctatttcgagtgggtgcaaaacctgcaaggctattattgggagtttgacgaagttcaggaaaaagaaatcgtcgtcctgcgccgcgcgttccgcgatatttggaacttggcgcaagagtatgatgtcgatttgcgtaccgcgtcttatatgatgagtatccgccgtgttgaaaaagcgatgaagctgcgcggctggtat

SEQ ID NO: 6102 - protein, 263 aa, Neisseria gonorrhoeae
MSWMVDAYENVVKHSAPGVFTGKPVEFGGSLARTEATGYGVNLAAVQALEKLGKDVKGATYAIQGFGNVGYHTGYYAHQSGAKVVTVSTVDVAIYNENGLDMEALFKEFQEKGFITNKAGYGKEITNAELLALDMDVLAPCALENQLTSENAGKVRAKIVVEGANGPTTPEADVILHQNGVLVVPDILANCGGVVVSYFEWVQNLQGYYWEFDEVQEKEIVVLRRAFRDIWNLAQEYDVDLRTASYMMSIRRVEKAMKLRGWY

SEQ ID NO: 6103 - DNA, 1044 bp, Neisseria gonorrhoeae
gtgccaaaaacaggcgaactacacaactttaaccttccaaatcggccattctcaccattaattccgtccaaacaaaaatgccgtctgaaatggtttcagacggcatcctttgttcaaacatcaataccagccgcgcagcttcatcgctttttcaacacggcggatactcatcatataagacgcggtacgcaaatcgacatcatactcttgcgccaagttccaaatatcgcggaacgcgcggcgcaggacgacgatttctttttcctgaacttcgtcaaactcccaataatagccttgcaggttttgcacccactcgaaataggaaacgaccacgccgccgcagtttgccaaaatatcgggcacgaccaatacgccgttttgatgcaggataacgtcggcttcgggcgtagtcgggccgtttgcgccttcaaccacgattttcgcgcggactttaccggcgttttcggaagtcagctggttttccaatgcgcaaggggcgagtacgtccatatccaaagccaaaagttcggcgttggtaatttctttgccgtaaccggctttgttggtgatgaagcctttttcttggaactctttaaacagcgcttccatatccaagccgttttcattgtagatagcaacgtcaacagtagatacggtaacgactttcgcgccggattgatgcgcgtaatagccggtgtggtagcccacattgccgaaaccttgaatggcgtaggttgcgcctttcacatctttgcccagtttttccaaagcttggacggcggcgaggttcacgccgtaaccggtagcctcggtacgcgccaaagagccgccgaactcaaccggtttgccggtaaatacgcccggcgcggaatgtttcaccacgttttcataggcatccaccatccacgacataattttgccgttggtgttcacatcgggggcgggaatatcgatttttttcgccgatcagcggggcaatcgcttcggcataagcgcgggcgatgcgttccagttccgcctcggaataatcgcgcggatccaagg

SEQ ID NO: 6104 - protein, 348 aa, Neisseria gonorrhoeae
VPKTGELHNFNLPNRPFSPLIPSKQKCRLKWFQTASFVQTSIPAAQLHRFFNTADTHHIRRGTQIDIILLRQVPNIAERAAQDDDFFFLNFVKLPIIALQVLHPLEIGNDHAAAVCQNIGHDQYAVLMQDNVGFGRSRAVCAFNHDFRADFTGVFGSQLVFQCARGEYVHIQSQKFGVGNFFAVTGFVGDEAFFLELFKQRFHIQAVFIVDSNVNSRYGNDFRAGLMRVIAGVVAHIAETLNGVGCAFHIFAQFFQSLDGGEVHAVTGSLGTRQRAAELNRFAGKYARRGMFHHVFIGIHHPRHNFAVGVHIGGGNIDFFRRSAGQSLRHKRGRCVPVPPRNNRADPR

SEQ ID NO: 6105 - DNA, 267 bp, Neisseria gonorrhoeae
gtgcgttcccatcccggtgtgaatctggacgaagtcaaggcactgtcgatttggatgaccatcaaatgctgcgttgcaggcattccttacggcggcggcaaaggcggcgttaccttggatccgcgcgattattccgaggcggaactggaacgcatcgcccgcgcttatgccgaagcgattgccccgctgatcggcgaaaaaaatcgatattcccgcccccgatgtgaacaccaacggcaaaattatgtcgtggatggtggatgccta

SEQ ID NO: 6106 - protein, 89 aa, Neisseria gonorrhoeae
VRSHPGVNLDEVKALSIWMTIKCCVAGIPYGGGKGGVTLDPRDYSEAELERIARAYAEAIAPLIGEKNRYSRPRCEHQRQNYVVDGGCL

SEQ ID NO: 6107 - DNA, 408 bp, Neisseria gonorrhoeae
atgtctgatgccgttgcaaaagaaaccctcaatccgtttgaaatcgcgcgaaaacaggtcaaaaccgcctgcgaccggctgaaaaccgatccggccgtttatgaaatcctgaagagtccgacccgcgtgttggaagtcaaactcgacgacggcacggtcaaaacctttaccggttaccgttcgcgtgcgttcccatcccggtgtgaatctggacgaagtcaaggcactgtcgatttggatgaccatcaaatgctgcgttgcaggcattccttacggcggcggcaaaggcggcgttaccttggatccgcgcgattattccgaggcggaactggaacgcatcgcccgcgcttatgccgaagcgattgccccgctgatcggcgaaaaaaatcgatattcccgcccccgatg

SEQ ID NO: 6108 - protein, 136 aa, Neisseria gonorrhoeae
MSDAVAKETLNPFEIARKQVKTACDRLKTDPAVYEILKSPTRVLEVKLDDGTVKTFTGYRSRAFPSRCESGRSQGTVDLDDHQMLRCRHSLRRRQRRRYLGSARLFRGGTGTHRPRLCRSDCPADRRKKSIFPPPM

SEQ ID NO: 6109 - DNA, 447 bp, Neisseria gonorrhoeae
atggacgtacaactccccatcgaagccaaagacatccaaaaactcatcccccaccgctacccgtttctccagctcgaccgcattaccgccttcgagccgatgaaaaccctgaccgccatcaaaaacgtaaccataaacgaaccccaattccaaggccatttccccgacctgcccgttatgcccggcgtactcatcatcgaagcgatggcgcaggcgtgcggcacgttggcgattttgagcgaaggcgggcgcaaggaaaacgaatttttcttcttcgccggcatagacgaagcccgtttcaaacgccaagtcatccccggcgaccaactcgtctttgaagtcgaactcctgaccagccggcgcggcatcggcaaattcaacgccgttgccaaagtggacggacaagtcgccgtcgaagccgtgattatgtgcgccaaacgcgtggtt

SEQ ID NO: 6110 - protein, 149 aa, Neisseria gonorrhoeae
MDVQLPIEAKDIQKLIPHRYPFLQLDRITAFEPMKTLTAIKNVTINEPQFQGHFPDLPVMPGVLIIEAMAQACGTLAILSEGGRKENEFFFFAGIDEARFKRQVIPGDQLVFEVELLTSRRGIGKFNAVAKVDGQVAVEAVIMCAKRVV

SEQ ID NO: 6111 - DNA, 3366 bp, Neisseria gonorrhoeae
gtgattgacgcggtgcgctgggtgttgggcgaggcttcggcgaagcagcttcgcggcgagagtatgcaggacgtgatttttaacggtgcggcgacgcgccgtcctgcgccgagggcttcggtggagctggtatttgacaacagcgaccacagtttgcagggcgcgtgggggcagtatgccgaggtgagcatcaagcggcagctgacgcgtcagggggaatcgacttatttcatcaacaatcagaccgtgcgccgccgcgatattactgatttgttcttgggtacgggcgtgggcgcgcgcggttatgccgtcattgagcaggggatgatttcgcgcatcatcgaagcgcggccggaggagttgcgcgcctatatcgaggaggcggcgggcgtgtccaaatataaggaacgccgcaaggagacggaaggccgtctgaaagacacgcgcgagcatttgcagcgtttgggcgatttgcagaacgagttggcgcgtcaggtggaaaagctggaaaaacaggcggaaaccgccgaacgctacaaatccctgaccgcgcagttgaatcaacaacaggatttgctcgattacgcccaatggcagcaatcgcttgccgccgccgacaaggcgaccgcgcagcatcaatctttgcaggcgcagcaggatgaaaccgccgcacaggttcaggcgttaaataacgaagtacacgccttgcagactgccgaacagtcgcagcagcaggcagtacacgaattgagcaacaaacgcggcgtgttgcgcgagcagattgcccgtttggaagaacaaatccgccaccggcaaaacctgcaccaacgcatcgaacgcgacaagcaggcagcgcaggcgcagttgcaacgcatccggcaggagcagcagcaaatccgcgtgcagcttgaggaaaacgagttgcaggtcgaagaaaagcaaaccgaattggcggaatgggcgatgcaggttgccgaacacgaagagcgtctgcccgaattggaagaagtccaagccacgctcaacgctgccttccaaacccagcaggacgaggcaaaccgcatccgccgcgaactggcgttgaagcagcagcagcttgcccatgccgaacaaaccgttgccaagcacgaagagcgcaaaggccgtctgaagcaggaaaaccaagccctgaacctgcccgacgaggccgaaaccgccgccgctcaggaagccgccgccttgttgcaaagccggcaagagcattacgaagaacaaatcattgccgccgaagaagccttgcacgccgcccgcgaggcgtttcagacggcctcaaaccgcttccaaagcctgaagcagcaacacattaccttgcaggcgcagcagcaggcgttgtcgcaaatcctgtcgcaacagcaggaagccgccgacttttggcaggcaaccgaccacgccgccgcgccgcaactgtggcaacacatcaccgcgcccgccgagtggcagcacgccctgtccgtcatccttgccgaacgcctgcacgcccgtagcgtgccgaatagtttcgtaccgcccgcacctttgccgcaggggcaggcggcatggctttcagacggcctctccggcggcatcaaaaaatccctgcccgtacaggcattgctgaaccaaatccaagcgcagccgccgtttcagacggcattgcaccactggctcgacggcgtattgtgcgcgcccgatttgagctacgccctcgcgcatcaaaacgatttgggcacgcatcaaatctggctcacacccgaaggccatcaggtcgataaggtcagcgtcctgctctatgccaagcccgcgcaggaaagcctgattgcccaaaaagcacgcctcgacggcatcgcggccgaactggaaaacctcgcccccggactttccgccgccgaagccgcgttcaaacagacggaggctgccgtgtgctcgtccgaagtgcagcacaaaaatctgatgcagcagcaacagcagcacacgcgccaatacagtcaagcgcagcaacgcaccgccgaacttctggcgcgcaccaaccaagggcaaatccgccgcgaacacatcgagcgcgaactggcacagttggcggaagagcagaccgtgttgcaacacacgtccgacgggctttcagacgacatcgctactttgcaggaagccgccgccgaactcgaacaccagcagcaaaccaccgcgcacagccgccaagagcagcaaggccgtctgaaacaggcgcagcttgccctgttggaagccaaccgccaatacgggcttgccgaagtcgccgtccacaaactcaaccagcaaaaacaaaactaccggcagcaaatcgcccggctcgaacagcaaaccctggactggcaggaacgccggcaagagcttgccctcgcctatgaaaccgagttccaaaacgacgagcagcacatcaagctcgacgagttgaccgaaaccgtacacacgctggacgaagaatacatcgccgtgcaggaaaaactcgcgcagattcaggaacagggcagggagcaatacgcccgcgtacaaaccctgcaaaccaagctgccgcagcttcaggccgccacccaaaccgccctgttgcagcagcaggaggccctgatcaacgccaaacgctaccatcaaaacctgaccgaacgcgctgccgatctggacgtgctcgaagcgttggcgaaagaatcggcgaaagtattgaacagcagcatcggcagccttacccggcaaatcgaagccctcggcgccgtcaacctcgccgccctgcaagaactcgaagaagcgcgcgaacgcgacggctactaccgcagccagagcgaagacgtgcaggccgccatcgcgcttttggaagaagccatcgcccaaatcgacgacaaaaccaaagcgcgtttcaaagaaactttcgacgccgtcaacggcaaagtccaaaccttcttcccgaccctgttcggcggcggcgaagccaccctcaaaatgataggcgacgacctcctgaccgccggcgtgtccatcatggcgcgtccgcccggcaagaaaaacagcaccatccacctcctctccggcggcgaaaaagccctcaccgccatgagcctcgtgttcgccctgttcagcctcaaccccgcccccttctgccttctggacgaagtcgatgccccgctggacgatgccaacacctcgcgtttctgcaagctggtcaaagaaatgtcggtgcaaacccagttcctctacatctcccacaaccgcctgaccatggaaatggcggagcagctggtcggcgtaaccatgcaggaaaaaggcgtgtcgcgcgttgtcgccgtggacatcaaacaggcgttggaaatggcggaagccgtt

SEQ ID NO: 6112 - protein, 1122 aa, Neisseria gonorrhoeae
VIDAVRWVLGEASAKQLRGESMQDVIFNGAATRRPAPRASVELVFDNSDHSLQGAWGQYAEVSIKRQLTRQGESTYFINNQTVRRRDITDLFLGTGVGARGYAVIEQGMISRIIEARPEELRAYIEEAAGVSKYKERRKETEGRLKDTREHLQRLGDLQNELARQVEKLEKQAETAERYKSLTAQLNQQQDLLDYAQWQQSLAAADKATAQHQSLQAQQDETAAQVQALNNEVHALQTAEQSQQQAVHELSNKRGVLREQIARLEEQIRHRQNLHQRIERDKQAAQAQLQRIRQEQQQIRVQLEENELQVEEKQTELAEWAMQVAEHEERLPELEEVQATLNAAFQTQQDEANRIRRELALKQQQLAHAEQTVAKHEERKGRLKQENQALNLPDEAETAAAQEAAALLQSRQEHYEEQIIAAEEALHAAREAFQTASNRFQSLKQQHITLQAQQQALSQILSQQQEAADFWQATDHAAAPQLWQHITAPAEWQHALSVILAERLHARSVPNSFVPPAPLPQGQAAWLSDGLSGGIKKSLPVQALLNQIQAQPPFQTALHHWLDGVLCAPDLSYALAHQNDLGTHQIWLTPEGHQVDKVSVLLYAKPAQESLIAQKARLDGIAAELENLAPGLSAAEAAFKQTEAAVCSSEVQHKNLMQQQQQHTRQYSQAQQRTAELLARTNQGQIRREHIERELAQLAEEQTVLQHTSDGLSDDIATLQEAAAELEHQQQTTAHSRQEQQGRLKQAQLALLEANRQYGLAEVAVHKLNQQKQNYRQQIARLEQQTLDWQERRQELALAYETEFQNDEQHIKLDELTETVHTLDEEYIAVQEKLAQIQEQGREQYARVQTLQTKLPQLQAATQTALLQQQEALINAKRYHQNLTERAADLDVLEALAKESAKVLNSSIGSLTRQIEALGAVNLAALQELEEARERDGYYRSQSEDVQAAIALLEEAIAQIDDKTKARFKETFDAVNGKVQTFFPTLFGGGEATLKMIGDDLLTAGVSIMARPPGKKNSTIHLLSGGEKALTAMSLVFALFSLNPAPFCLLDEVDAPLDDANTSRFCKLVKEMSVQTQFLYISHNRLTMEMAEQLVGVTMQEKGVSRVVAVDIKQALEMAEAV

SEQ ID NO: 6113 - DNA, 237 bp, Neisseria gonorrhoeae
atgattttatttttcaagccgcacagcatccgtctgaaaaaagcagcgcgcatccgaaaagcaaatgtccaattaaataaagatatagtcatcattttattttttaaaaatttaattggaacatcgccgggatttcaaacccttgccagaccccgccataaaatccgaaaacaccgcccgaaaaacctgttgcgattgttaataatctatacattagaagccctgtgcaaacgatgt

SEQ ID NO: 6114 - protein, 79 aa, Neisseria gonorrhoeae
MILFFKPHSIRLKKAARIRKANVQLNKDIVIILFFKNLIGTSPGFQTLARPRHKIRKHRPKNLLRLLIIYTLEALCKRC

SEQ ID NO: 6115 - DNA, 708 bp, Neisseria gonorrhoeae
atgaatgcagccatcgaacacgtccaagccgtcgccttcgatttggacggcacactgtgcgattccgtccccgaccttgccgccgccgcagaagcgatgttggaacaactcggtatgaaaccgctgcccgccaaagtggtcgaaagctacgtcggcgacggcatcggcaaactggttcaccgcgtcctcaccaacgaccgcgaccgcgaagccgattccgaactgtgggaaaaaggtttcgtgtcctatatgaaatactaccgcgaccatttgagcgtcttcacccgcccctatcccgaaaccgaagccgggctggcattgctcaaatccttgggcattccgctggtaatcattaccaacaaaaacgaaatccttgccgccgagcttctaaaacaactgggactcgccgactacttcagcctgatactcggcggagacagcctgcccgaaaaaaaacccagcccgctgccgctgcggcacgccgccgaagttttgggtatcgatgccgccaatatgcttatggtcggcgactcgcgcaacgacatcatcgccgccaaagccgccggctgcctgagtgtcggcgttaccttcggttacggcgatatgacgctgctctcgcaagacgatacgacccgccccgaccggattatcggcgcgctgcccgaaatttacgaaaacctgcaaccgcagaaaaacaaagacgaagaa

SEQ ID NO: 6116 - protein, 236 aa, Neisseria gonorrhoeae
MNAAIEHVQAVAFDLDGTLCDSVPDLAAAAEAMLEQLGMKPLPAKVVESYVGDGIGKLVHRVLTNDRDREADSELWEKGFVSYMKYYRDHLSVFTRPYPETEAGLALLKSLGIPLVIITNKNEILAAELLKQLGLADYFSLILGGDSLPEKKPSPLPLRHAAEVLGIDAANMLMVGDSRNDIIAAKAAGCLSVGVTFGYGDMTLLSQDDTTRPDRIIGALPEIYENLQPQKNKDEE

SEQ ID NO: 6117 - DNA, 459 bp, Neisseria gonorrhoeae
atgaaaccgcaaaaatccctacgcgcccgcgcgatggacatcctctcgcgccaagaagtcagccgcatcggtctgaaacgcaaacttgcaccgcacgccgaaagcgaagaggagttggaaaacgtgttaaacgaatttgccgaacgcaactggcagtcggatttgcgctacgccgaagcctatatccgcagcaaaagccgcaaacacggttcattgaggctgaaacaggctttggcgcaacagggcatagatgaaaaaaccagccgcaacctgcttcccgaccgctcaagcgaaaagcaagccgccatagccgtgttgcgtaaaaaattcaaacatcccgccgccaacctcaaagaaaaacaaaaacaggcgcgtttcctcgcctatcgcggttttgatgccgataccgttcagacggcattgaaacacgcttgggacgaaaattgggaagacagctgc

SEQ ID NO: 6118 - protein, 153 aa, Neisseria gonorrhoeae
MKPQKSLRARAMDILSRQEVSRIGLKRKLAPHAESEEELENVLNEFAERNWQSDLRYAEAYIRSKSRKHGSLRLKQALAQQGIDEKTSRNLLPDRSSEKQAAIAVLRKKFKHPAANLKEKQKQARFLAYRGFDADTVQTALKHAWDENWEDSC

SEQ ID NO: 6119 - DNA, 159 bp, Neisseria gonorrhoeae
atgtccgaacaacccgaaaaacaccacgcctcccccatcgaagacgaacgcaaaaacccggtttaccgtatgggacgggcggttgccggattcatgctcgccgtttgggcgggcgtgctggcactcgtgtttttcttggttttccgtttttggctttcc

SEQ ID NO: 6120 - protein, 53 aa, Neisseria gonorrhoeae
MSEQPEKHHASPIEDERKNPVYRMGRAVAGFMLAVWAGVLALVFFLVFRFWLS

SEQ ID NO: 6121 - DNA, 480 bp, Neisseria gonorrhoeae
atgacacaacaacgccaactgccttcccacgaactcattatgtccgaactgatgatgccggacaccgccaatttcagcggcaacgtacacggcggcgaactcctgctcctgctcgaccaggttgcctattcctgcgccagccgttacagcggcaattattgcgttaccctttcggttgacaaagtcctgtttaaagaacccatccacatcggcgatttggttaccttttacgccgctgtcaactacacgggacgcacctcgatggaaatcggcatccgtgtcgaagcacaaaacatccgcaccggcgaaatccgccataccaacagctgctacttcacgatggttgcggtcaaagacggcaaacccgtccccgtccctccgctggaaatcctgaccgaccgccaacgctgccgctacgaaaaagccaaaaaacgcagagaaatcagcctccaagcctccggagacgtgtcctgcggctgc

SEQ ID NO: 6122 - protein, 160 aa, Neisseria gonorrhoeae
MTQQRQLPSHELIMSELMMPDTANFSGNVHGGELLLLLDQVAYSCASRYSGNYCVTLSVDKVLFKEPIHIGDLVTFYAAVNYTGRTSMEIGIRVEAQNIRTGEIRHTNSCYFTMVAVKDGKPVPVPPLEILTDRQRCRYEKAKKRREISLQASGDVSCGC

SEQ ID NO: 6123 - DNA, 768 bp, Neisseria gonorrhoeae
atgcttgtcctgtctttcagacggcataggccgccgtcagcagccgcaggacacgtctccggaggcttggaggctgatttctctgcgttttttggctttttcgtagcggcagcgttggcggtcggtcaggatttccagcggagggacggggacgggtttgccgtctttgaccgcaaccatcgtgaagtagcagctgttggtatggcggatttcgccggtgcggatgttttgtgcttcgacacggatgccgatttccatcgaggtgcgtcccgtgtagttgacagcggcgtaaaaggtaaccaaatcgccgatgtggatgggttctttaaacaggactttgtcaaccgaaagggtaacgcaataattgccgctgtaacggctggcgcaggaataggcaacctggtcgagcaggagcaggagttcgccgccgtgtacgttgccgctgaaattggcggtgtccggcatcatcagttcggacataatgagttcgtgggaaggcagttggcgttgttgtgtcatggtgtacctgttttaagaaagggtgttttgaaatgggtgcgggaaaattttagggaatggggaagtggaattcaagctaaaaaaagctatggagggatagtctgccgaaatgggccgccgatgccgtctgaagccttcagacggcattttgttcaggaaagccaaaaacggaaaaccaagaaaaacacgagtgccagcacgcccgcccaaacggcgagcatgaatccggcaaccgcccgtcccatacgg

SEQ ID NO: 6124 - protein, 256 aa, Neisseria gonorrhoeae
MLVLSFRRHRPPSAAAGHVSGGLEADFSAFFGFFVAAALAVGQDFQRRDGDGFAVFDRNHREVAAVGMADFAGADVLCFDTDADFHRGASRVVDSGVKGNQIADVDGFFKQDFVNRKGNAIIAAVTAGAGIGNLVEQEQEFAAVYVAAEIGGVRHHQFGHNEFVGRQLALLCHGVPVLRKGVLKWVRENFREWGSGIQAKKSYGGIVCRNGPPMPSEAFRRHFVQESQKRKTKKNTSASTPAQTASMNPATARPIR

SEQ ID NO: 6125 - DNA, 195 bp, Neisseria gonorrhoeae
ttgaagccggagagtttgatgtgggtcaggcgcataatggtcggaaaaaataaaaaagaagcgtattttaacggaaatcccgccgcaccaccccatatcttgccggcaaaaccttaccgcatcccgccccggtgcggcaggattttgcacatcccggccatccgtattaaaatctttgcgtttcccacactttcc

SEQ ID NO: 6126 - protein, 65 aa, Neisseria gonorrhoeae
LKPESLMWVRRIMVGKNKKEAYFNGNPAAPPHILPAKPYRIPPRCGRILHIPAIRIKIFAFPTLS

SEQ ID NO: 6127 - DNA, 1296 bp, Neisseria gonorrhoeae; identical to SEQ ID NO: 1889

SEQ ID NO: 6128 - protein, 432 aa, Neisseria gonorrhoeae; identical to SEQ ID NO: 1890

SEQ ID NO: 6129 - DNA, 552 bp, Neisseria gonorrhoeae
aggaatacgacagacatggacgtacaactccccatcgaagccaaagacatccaaaaactcatcccccaccgctacccgtttctccagctcgaccgcattaccgccttcgagccgatgaaaaccctgaccgccatcaaaaacgtaaccataaacgaaccccaattccaaggccatttccccgacctgcccgttatgcccggcgtactcatcatcgaagcgatggcgcaggcgtgcggcacgttggcgattttgagcgaaggcgggcgcaaggaaaacgaatttttcttcttcgccggcatagacgaagcccgtttcaaacgccaagtcatccccggcgaccaactcgtctttgaagtcgaactcctgaccagccggcgcggcatcggcaaattcaacgccgttgccaaagtggacggacaagtcgccgtcgaagccgtgattatgtgcgccaaacgcgtggtttgagcgttcggaaaaaggtcgtctgaaagtttcagacgacctaataaaaagaaaacccaccggtttaggtttattcaaacccagggacac

SEQ ID NO: 6130 - protein, 154 aa, Neisseria gonorrhoeae
RNTTDMDVQLPIEAKDIQKLIPHRYPFLQLDRITAFEPMKTLTAIKNVTINEPQFQGHFPDLPVMPGVLIIEAMAQACGTLAILSEGGRKENEFFFFAGIDEARFKRQVIPGDQLVFEVELLTSRRGIGKFNAVAKVDGQVAVEAVIMCAKRVV

SEQ ID NO: 6131 - DNA, 138 bp, Neisseria gonorrhoeae
ttgcaaacggatgaaatcaagcaaatacccaaacacagtcaaacaaatttatacgccccgtcccttcggaatgatttgaaaacacagccgccaaaacaaaaatgccgtctgaagacctttcagacggcatttttaacc

SEQ ID NO: 6132 - protein, 46 aa, Neisseria gonorrhoeae
LQTDEIKQIPKHSQTNLYAPSLRNDLKTQPPKQKCRLKTFQTAFLT

SEQ ID NO: 6133 - DNA, 111 bp, Neisseria gonorrhoeae
atgccgtctgaaaggtcttcagacggcatttttgttttggcggctgtgttttcaaatcattccgaagggacggggcgtataaatttgtttgactgtgtttgggtatttgct

SEQ ID NO: 6134 - protein, 37 aa, Neisseria gonorrhoeae
MPSERSSDGIFVLAAVFSNHSEGTGRINLFDCVWVFA

SEQ ID NO: 6135 - DNA, 180 bp, Neisseria gonorrhoeae
ttgacgcacctcgaaatgaagctgcgttctggaagcatcggtattacccatcaaagcaacctgctgaccgcgtttgacctgctgaccttcgccgaccagcaatttttggttgtgcccgtacgcggtcaggaaagaggaattgtgctggatgatgaccaagtttccgtatcccctcaaacc

SEQ ID NO: 6136 - protein, 60 aa, Neisseria gonorrhoeae
LTHLEMKLRSGSIGITHQSNLLTAFDLLTFADQQFLVVPVRGQERGIVLDDDQVSVSPQT

SEQ ID NO: 6137 - DNA, 1128 bp, Neisseria gonorrhoeae
ttggcatacggactgaccgtttttcaaataccgtcgggttttgcgcttgagaagaacgcgcatttttattatgatataccgcattcaggctatatatcggaacatgaaggttatcttatgttgaaacaaacgacacttttggcagcttgtaccgccgttgccgctctgttgggcggttgcgccacccaacagcctgctcctgtcattgcaggcaattcaggtatgcagaccgtatcgtctgcgccggtttacaatccttatggcgcaacgccgtacaatgccgctcctgccgccaacgatgcgccgtatgtgccgcccgtgcaaactgcgccggtttattcgcctcctgcttatgttccgccgtctgcacctgccgtttcgggtacatatgttccttcttacgcacccgtcgacatcaacgcggcgacgcatactattgtgcgtggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaaaccgcagccgtagaaagcaggcccgccgtaccggctgccgcgcaaacccctgtgaaacccgccgcgcaaccgcccgttcagtccgcgccgcaacctgccgcgcccgctgcggaaaataaagcggttcccgcccccgcgcccgccccgcaatctcctgccgcttcgccttccggcacgcgttcggtcggcggcattgtttggcagcgtccgacccaaggtaaagtggttgccgatttcggcggcggcaacaagggtgtcgatattgccggcaatgccggacaacccgttttggcggcggctgacggcaaagtggtttatgccggttcaggtttgaggggatacggaaacttggtcatcatccagcacaattcctctttcctgaccgcgtacgggcacaaccaaaaattgctggtcggcgaaggtcagcaggtcaaacgcggtcagcaggttgctttgatgggtaataccgatgcttccagaacgcagcttcatttcgaggtgcgtcaaaacggcaaaccggttaacccgaacagctatatcgcgttc

SEQ ID NO: 6138 - protein, 376 aa, Neisseria gonorrhoeae
LAYGLTVFQIPSGFALEKNAHFYYDIPHSGYISEHEGYLMLKQTTLLAACTAVAALLGGCATQQPAPVIAGNSGMQTVSSAPVYNPYGATPYNAAPAANDAPYVPPVQTAPVYSPPAYVPPSAPAVSGTYVPSYAPVDINAATHTIVRGDTVYNISKRYHISQDDFRAWNGMTDNTLSIGQIVKVKPAGYAAPKTAAVESRPAVPAAAQTPVKPAAQPPVQSAPQPAAPAAENKAVPAPAPAPQSPAASPSGTRSVGGIVWQRPTQGKVVADFGGGNKGVDIAGNAGQPVLAAADGKVVYAGSGLRGYGNLVIIQHNSSFLTAYGHNQKLLVGEGQQVKRGQQVALMGNTDASRTQLHFEVRQNGKPVNPNSYIAF

SEQ ID NO: 6139 - DNA, 489 bp, Neisseria gonorrhoeae
gtgttttcaggtatcaaccgtggcgcaaatatgggcgacgatacgctttattcggggacggttgcggcggcgaccgaagcctatctgatgggtatgcctgctgtggcgttttctttaaacgatgcttccggacgctattgggcaaccgcagaaaaggcactgtggacattgttggcgcatttttttaaaaaaccgccgtccgcgcccgtcttgtggaatgtcaacatccctgctgtcgcaccggaagatgtcaggggaatcaagattacccgtttgggcagacggcatcatgagcagaacatcgtcccgtcccgcaatccgcgcggcgaacagatttattggatagggccggtcggcgaagtttccgatcgggaagaggggacggattttggtgaatgcggcgcaggttttattaccgtaacgccgctgcaaatcgatttgaccgcctatccggacatggcggagacggcggccttttggcatacggac

SEQ ID NO: 6140 - protein, 163 aa, Neisseria gonorrhoeae
VFSGINRGANMGDDTLYSGTVAAATEAYLMGMPAVAFSLNDASGRYWATAEKALWTLLAHFFKKPPSAPVLWNVNIPAVAPEDVRGIKITRLGRRHHEQNIVPSRNPRGEQIYWIGPVGEVSDREEGTDFGECGAGFITVTPLQIDLTAYPDMAETAAFWHTD

SEQ ID NO: 6141 - DNA, 135 bp, Neisseria gonorrhoeae
  MISC_FEATURE (1)..(135): n = g, a, t, or c
atgaacgttttgatttccaacgacgacggctatctggcagaaggcattgccattctggcgcgggttgcgtcggaatttgccaatgtcagggtggtcgcgcccgagccgggaacaggagcggggtcagcaattcgn

SEQ ID NO: 6142 - protein, 45 aa, Neisseria gonorrhoeae
MNVLISNDDGYLAEGIAILARVASEFANVRVVAPEPGTGAGSAIR

SEQ ID NO: 6143 - DNA, 762 bp, Neisseria gonorrhoeae
ttgcaattcttccataatcagcccggcaacggtatggaaatcggtatcttcctcctgctgcggcaggttgagttgggatgccagctccacatattccaacgcgccttccaccgtcaggctttcatcgggattctcctgaacggcgggttcttcttcgcgctcgaattcttcggggaactcgcctgcgatggcttccaacaggtctttcatcgtcaccatacccaacaccgcgccgaactcgtccaccaccaaagcgtaatccgcgctgctttggcggaagagttcgagcgcgcccaaggcggtcgtgccgtcgggcaggacgagcggctggcgcaatgccgtctgaatgtcgagaccgcctgtttccagcagttgggacagcaggtcttttttgttgatgtagcccaacggttcgtccacgcccgcctttccgacaacgagcaggcggctgtaaggcgtgttttgcagttgggcatactgttcttcgcggctttgggaaatgtccagccgttcgatgtcgcggcgtggaatcatcacccccataatcgggcgttcggcaagcgtcagcacgctgcgtatcatcgatttttcgttttcttcaaaatgcgcgtcatccacggattcgccgcccgcatcagcaagcacgctttcgcgtatgcccatcatacccaaaacgttttcggcggtgcgcttgcgccacgagctgccgatgtagtcgtttttgcggctgttgcgttgcgaaatctggttaaacagttcgat

SEQ ID NO: 6144 - protein, 254 aa, Neisseria gonorrhoeae
LQFFHNQPGNGMEIGIFLLLRQVELGCQLHIFQRAFHRQAFIGILLNGGFFFALEFFGELACDGFQQVFHRHHTQHRAELVHHQSVIRAALAEEFERAQGGRAVGQDERLAQCRLNVETACFQQLGQQVFFVDVAQRFVHARLSDNEQAAVRRVLQLGILFFAALGNVQPFDVAAWNHHPHNRAFGKRQHAAYHRFFVFFKMRVIHGFAARISKHAFAYAHHTQNVFGGALAPRAADVVVFAAVALRNLVKQFD

SEQ ID NO: 6145 - DNA, 1584 bp, Neisseria gonorrhoeae
ttgcgtttgaacttgaggaacacgaaaatcatggatttcagttggttggcagaaccgcatacctggataggttttgccacgcttttggtgttggaagtcgtattggggatagacaaccttgtctttgtggcgattttggcaaacaaggtccagcccgcacggcgcgaccgcgcacggattaccgggctggggctggcagtcgtcatccgcatcattatgcttgcttttatggcgcatatcatcacgctgaccgaaccgctgttccaaatcggcggcctcgccgtttccggcaaggacatgattatgctcgcgggcggtattttcctgctttacaaagccactaccgaactgcacgaacgcctcgaagggcataaccggtttgccgttgccgacaaccaaaaaaaacacgcgccgttttggggcgtggtcgcgcaaatcctgatactggatgccgtgttttccatcgattcggtcatcaccgccgtggcgatggtcgatcacatcgtcgtggcgatgggcgcggtcgtcgtcgcaatggctgtcatgatttccgccagcaaactcttgaccgaatttgtggacaggcatcccaccgtcgtgatgctctgccttggttttttgttgatgatcggtttcagcctgattgcggaagccttccatttccacattcccaaaggctacctctacgccgccatcggcttctcgattttaatcgaactgtttaaccagatttcgcaacgcaacagccgcaaaaacgactacatcggcagctcgtggcgcaagcgcaccgccgaaaacgttttgggtatgatgggcatacgcgaaagcgtgcttgctgatgcgggcggcgaatccgtggatgacgcgcattttgaagaaaacgaaaaatcgatgatacgcagcgtgctgacgcttgccgaacgcccgattatgggggtgatgattccacgccgcgacatcgaacggctggacatttcccaaagccgcgaagaacagtatgcccaactgcaaaacacgccttacagccgcctgctcgttgtcggaaaggcgggcgtggacgaaccgttgggctacatcaacaaaaaagacctgctgtcccaactgctggaaacaggcggtctcgacattcagacggcattgcgccagccgctcgtcctgcccgacggcacgaccgccttgggcgcgctcgaactcttccgccaaagcagcgcggattacgctttggtggtggacgagttcggcgcggtgttgggtatggtgacgatgaaagacctgttggaagccatcgcaggcgagttccccgaagaattcgagcgcgaagaagaacccgccgttcaggagaatcccgatgaaagcctgacggtggaaggcgcgttggaatatgtggagctggcatcccaactcaacctgccgcagcaggaggaagataccgatttccataccgttgccgggctgattatggaagaattgcaaaccatccccgatgtcggcgattttgccgattttcacggctggcggtttgaagtggtcgaaaaagaagggcagcgcatcgagcgggtcaaaatcaccaaattgcccgaagaa

SEQ ID NO: 6146 - protein, 528 aa, Neisseria gonorrhoeae
LRLNLRNTKIMDFSWLAEPHTWIGFATLLVLEVVLGIDNLVFVAILANKVQPARRDRARITGLGLAVVIRIIMLAFMAHIITLTEPLFQIGGLAVSGKDMIMLAGGIFLLYKATTELHERLEGHNRFAVADNQKKHAPFWGVVAQILILDAVFSIDSVITAVAMVDHIVVAMGAVVVAMAVMISASKLLTEFVDRHPTVVMLCLGFLLMIGFSLIAEAFHFHIPKGYLYAAIGFSILIELFNQISQRNSRKNDYIGSSWRKRTAENVLGMMGIRESVLADAGGESVDDAHFEENEKSMIRSVLTLAERPIMGVMIPRRDIERLDISQSREEQYAQLQNTPYSRLLVVGKAGVDEPLGYINKKDLLSQLLETGGLDIQTALRQPLVLPDGTTALGALELFRQSSADYALVVDEFGAVLGMVTMKDLLEAIAGEFPEEFEREEEPAVQENPDESLTVEGALEYVELASQLNLPQQEEDTDFHTVAGLIMEELQTIPDVGDFADFHGWRFEVVEKEGQRIERVKITKLPEE

SEQ ID NO: 6147 - DNA, 765 bp, Neisseria gonorrhoeae; identical to SEQ ID NO: 155

SEQ ID NO: 6148 - protein, 255 aa, Neisseria gonorrhoeae
LKRQFKNKESRVSVNYKECCSIFSDFRMERYKNAVRKDKAAELYLLNLSLSRELFHVVSIFEIVLRNKIDICFRQEFKDRNRLYDSIQPQTNPALKYQGCFLRNGTKESAELIKVALSKIQNNSGGKFDHNQLVAGLGFGFWRYLFAGGKDAQFDAAGKVLMKVFPKKPKSTPSVQYNQKWIFRELSNINNFRNRLAHHEPICFSFKGAIKDTGYARNIHQSIFELLNYMDVDTASVFSHFSDQVIAVCDEIDKL

SEQ ID NO: 6149 - DNA, 147 bp, Neisseria gonorrhoeae
ttgcgtttcccacactttcctgacaaatatacggaggaggattccatgaaaacaaaaacagtcaagcaagcaagcaagcaagcaagcaagcaagcaagcaagcaagcaagcaagcaagcaagcaagcaagcaagcaagcaagcaaaa

SEQ ID NO: 6150 - protein, 49 aa, Neisseria gonorrhoeae
LRFPHFPDKYTEEDSMKTKTVKQASKQASKQASKQASKQASKQASKQAK

SEQ ID NO: 6151 - DNA, 189 bp, Neisseria gonorrhoeae
ttgaaacatttcaaaataagcccatgccgtccgaacatcctttcagacggcatggcgttttgccattgccccgataagctgttaaactgtttaaattatttcgaccgaaggtacacgcacatgaaagaccccgagcagagcagtaagcccgcccgccgttttttgtgcgtactgtctgttcaggcagct

SEQ ID NO: 6152 - protein, 63 aa, Neisseria gonorrhoeae
LKHFKISPCRPNILSDGMAFCHCPDKLLNCLNYFDRRYTHMKDPEQSSKPARRFLCVLSVQAA

SEQ ID NO: 6153 - DNA, 783 bp, Neisseria gonorrhoeae
atgatggaaaacggaaaaacattcccgagatggcgttttgccttgaaaagtgcgggctggcacctcttaatcagcctattggttgcagggctggcggccttgctggtttttaaggtttggtatccttatccttatgccgagctgacgggcggtctgtcgctttatcagctggtggtggcggtcgatatcgtatgcggcccgctgctgactttaattttggcaagcccgaagaaaaagacaaaggcacgcatggtcgatttttccatggtcggcatcatccagctggcggctttggcgtacggtttgcacagcgtttcgctggcgcgtcccgtggtggaagcgtttgaacaggaccgcatgaccattgttacggcggcggaagtcgtggtcgaagatttgcacaaagcccccgaagggctgcaaagcctgtcgtggttcggcatccgccgcattgcattgaaagaacctgaggatgcggatgagaagaacaagacgctggatttgtccctgaaaggtatcgagccgagtatgcgtcccgaccggtggctgccgtattccgacaaggaagcagaaaaaatccgcaaacatctgaaaccgctgaaagtcttggcggatgcgagaaaaacgacggttgcggacattctgaaacaggcaggtctcgccgaaggggaggagctgtattacctgccgtttaccagcagcaggcagaaagagtggatagtcattaccgataaagagggcaacaccaaaggctacgcgccgatagacggcttcatcatccct

SEQ ID NO: 6154 - protein, 261 aa, Neisseria gonorrhoeae
MMENGKTFPRWRFALKSAGWHLLISLLVAGLAALLVFKVWYPYPYAELTGGLSLYQLVVAVDIVCGPLLTLILASPKKKTKARMVDFSMVGIIQLAALAYGLHSVSLARPVVEAFEQDRMTIVTAAEVVVEDLHKAPEGLQSLSWFGIRRIALKEPEDADEKNKTLDLSLKGIEPSMRPDRWLPYSDKEAEKIRKHLKPLKVLADARKTTVADILKQAGLAEGEELYYLPFTSSRQKEWIVITDKEGNTKGYAPIDGFIIP

SEQ ID NO: 6155 - DNA, 90 bp, Neisseria gonorrhoeae
atgccgtctgaatggcagggtttcagacggtgtcgcattttaagcagtctctatctgttgtacaatgcgccctgtttttacggttatttt

SEQ ID NO: 6156 - protein, 30 aa, Neisseria gonorrhoeae
MPSEWQGFRRCRILSSLYLLYNAPCFYGYF

SEQ ID NO: 6157 - DNA, 1467 bp, Neisseria gonorrhoeae
ttgaaagcggttatcccgtataccggaggacacgaaatgaacgaatattcccaattaatcaagcatcccgatatttccctttccccgatttcagacggcatcggggtcggcaatccggcgacgggcgaaattttggcgtatgtccgcaacacgggttcggacaagctgaaaaacctgattcaaaaggcggcggcagcgcaaaaattatgggcggcgaaaaccgccttggaacgcgccgacatattgtggcgttggtattttttagttaaagaaaacaaagaagcactggcgcgtctcatgacgatggagcagggcaaaagcctgaccgaggcgcgcggcgaaatcgattatgcggcttcgtttgtgcgctggtttgccgaagaggcgcggcggattgacggcgatgtgctgacgagtgtgaaagcgtcgcaaaaactggttgtgttgaaacagcccgtcggcgttaccgctgcgattacgccgtggaatttcccgtccgcgatgattgcgcgcaaggccgcgcctgctttggcggtgggctgcgcgatgatagtcaaacctgcatcgctcacgcctttgagtgcgtatgcgttggctgtactggcctacgaagcgggcgtgccgcaggatttgcttcccgtcgtcagcggccgcgcttcggaaatcagccatgaatttgccacgaacccgaccgtgcgcaaaatcagcttcaccggctcgaccgaagtcggcgcgaaaatttttgccggcagcgcggcggacattaaaaaactcagtttggaactgggcggcaacgcgccgtttatcgtgtttgacgatgccgatttggacaaagccgtcgaaggcgcgctggcgagcaagttccgcaacagcggtcagacctgcgtctgcaccaaccgcgtttacgtccaatcgggcatttacgacgtattttgccgcaaattgagtgaaaaggcagccgcgctcaaattgggcgacggcttggacgaaggtgtgaaccaaggaccgctgattgaggaaaaagcggtagaaaaagtcgaacagcacatcgccgacgcactctccaaaggcgcggtctgtctgaccggcggcaaacgcagcgcgttgggcggaacgttttttgagccgactgtcttaagcggcgttacggcgcaaatggcggtagctcgcgaggaaaccttcgggcctttgtgtccggtgttccgttttgaaaccgaagccgaagtcatcgaggctgcgaacaatacggaatacggtttggcagcttaccttttcacctccgacaccgcccgtcaatggcgcgtcggcgaagtcttggaatacggcatggtcggcatcaatacgggcttaatcagtaatgaagcggcaccgttcggcggggtgaaacgcagcggtttgggacgtgaaggcagcaaatacggtgcggacgaatatctagaattgaaatatttgtgcattgatgccggg

SEQ ID NO: 6158 - protein, 489 aa, Neisseria gonorrhoeae
LKAVIPYTGGHEMNEYSQLIKHPDISLSPISDGIGVGNPATGEILAYVRNTGSDKLKNLIQKAAAAQKLWAAKTALERADILWRWYFLVKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALAVLAYEAGVPQDLLPVVSGRASEISHEFATNPTVRKISFTGSTEVGAKIFAGSAADIKKLSLELGGNAPFIVFDDADLDKAVEGALASKFRNSGQTCVCTNRVYVQSGIYDVFCRKLSEKAAALKLGDGLDEGVNQGPLIEEKAVEKVEQHIADALSKGAVCLTGGKRSALGGTFFEPTVLSGVTAQMAVAREETFGPLCPVFRFETEAEVIEAANNTEYGLAAYLFTSDTARQWRVGEVLEYGMVGINTGLISNEAAPFGGVKRSGLGREGSKYGADEYLELKYLCIDAG

SEQ ID NO: 6159 - DNA, 222 bp, Neisseria gonorrhoeae
ttgcttcttatatattgtaccctatcaaagggctgcattacttttctttctaaagattactatcgcataaaaagtatttttcttaaacgacagggatgcgcccgtgccatattcaaacaccgcccggatgttgcgctgcccgatcggatgcttcagacggcatcggaagggtttgcagttttggaatatgaagatgataatgtccgcgagattgacggcatt

SEQ ID NO: 6160 - protein, 74 aa, Neisseria gonorrhoeae
LLLIYCTLSKGCITFLSKDYYRIKSIFLKRQGCARAIFKHRPDVALPDRMLQTASEGFAVLEYEDDNVREIDGI

SEQ ID NO: 6161 - DNA, 288 bp, Neisseria gonorrhoeae
ttgtcaggaaagtgtgggaaacgcaaagattttaatacggatggccgggatgtgcaaaatcctgccgcaccggggcgggatgcggtaaggttttgccggcaagatatggggtggtgcggcgggatttccgttaaaatacgcttcttttttattttttccgaccattatgcgcctgacccacatcaaactctccggcttcaaatcttttaccgacccgaccacgattcatgttccggggcagcttgtcgcggttatcgggccgaacggctgcggcaagtcgaatgtgat

SEQ ID NO: 6162 - protein, 96 aa, Neisseria gonorrhoeae
LSGKCGKRKDFNTDGRDVQNPAAPGRDAVRFCRQDMGWCGGISVKIRFFFIFSDHYAPDPHQTLRLQIFYRPDHDSCSGAACRGYRAERLRQVECD

SEQ ID NO: 6163 - DNA, 96 bp, Neisseria gonorrhoeae
ttggccgtcggctggttccggcggttttcgggcgtggcggattatttttcgtttcgttctgggtttatcctgtcggcagcggctcaatgccaactt

SEQ ID NO: 6164 - protein, 32 aa, Neisseria gonorrhoeae
LAVGWFRRFSGVADYFSFRSGFILSAAAQCQL

SEQ ID NO: 6165 - DNA, 792 bp, Neisseria gonorrhoeae
atgttcaggtttggggttaacggcaatagaccacctatatccccccatatcctgccattggataccgacaatgaaactttaggcacgacggtcttgcaagcgttggcaaacagcaggactttcgtttatgacagttcggaagaccaagatttttttgataccgaaaaatttcggcaacgctatgaggattgggttgccaacctatgcgggaacttgggctataaaaccagacgcgccctatttaaaaacatgatgagcggggatatttggctgcacaacggctgcctgaaaatcagcccgagccgccatgtcaagccggaagcgtgggatgccattgatgcagacgatgtaattttatcattggataacagccctgaagaaatcggagcaggtttaaagttggcattgagccgctgccgacaggataaacccagaacgaaacgaaaaataatccgccacgcccgaaaaccgccggaaccagccgacggccaaaacaaaaccggcataaaaaaccgcccgaaaaatccggacggcggttcaaacaggctgccccgtttaacgggcgcggcaggaagtttcgaccgaattgccgtaggcatcggtaaagccgaaaaaggcttcgccgcctttctggtgccactcggttccgtttccgaacaaaccgtgttcggcggtatagcgttcgccggatgcggcaacgtcggaagagaggacggcacgcctgccgtccagccgcaacgcgattttgccgccgtccaaattgcggacgcgcacagacaaaccgttctcgca

SEQ ID NO: 6166 - protein, 264 aa, Neisseria gonorrhoeae
MFRFGVNGNRPPISPHILPLDTDNETLGTTVLQALANSRTFVYDSSEDQDFFDTEKFRQRYEDWVANLCGNLGYKTRRALFKNMMSGDIWLHNGCLKISPSRHVKPEAWDAIDADDVILSLDNSPEEIGAGLKLALSRCRQDKPRTKRKIIRHARKPPEPADGQNKTGIKNRPKNPDGGSNRLPRLTGAAGSFDRIAVGIGKAEKGFAAFLVPLGSVSEQTVFGGIAFAGCGNVGREDGTPAVQPQRDFAAVQIADAHRQTVLA

SEQ ID NO: 6167 - DNA, 285 bp, Neisseria gonorrhoeae
atgccgcctgttcaaaaccaagccggcccggacgattttcgagcgttttcatgcgagaacggtttgtctgtgcgcgtccgcaatttggacggcggcaaaatcgcgttgcggctggacggcaggcgtgccgtcctctcttccgacgttgccgcatccggcgaacgctataccgccgaacacggtttgttcggaaacggaaccgagtggcaccagaaaggcggcgaagcctttttcggctttaccgatgcctacggcaattcggtcgaaacttcctgccgcgcccgt

SEQ ID NO: 6168 - protein, 95 aa, Neisseria gonorrhoeae
MPPVQNQAGPDDFRAFSCENGLSVRVRNLDGGKIALRLDGRRAVLSSDVAASGERYTAEHGLFGNGTEWHQKGGEAFFGFTDAYGNSVETSCRAR

SEQ ID NO: 6169 - DNA, 159 bp, Neisseria gonorrhoeae
ttgaacaggcggcatatacccgcgtccgccgccatcatacgcttccggcacggcacaggccgccaaagacaaaaccgatacggtcagcgcgaaaaacctgatattcataaaagctccccaataaaaagaaaatatgtttcaacacacaggacgacacat

SEQ ID NO: 6170 - protein, 53 aa, Neisseria gonorrhoeae
LNRRHIPASAAIIRFRHGTGRQRQNRYGQREKPDIHKSSPIKRKYVSTHRTTH

SEQ ID NO: 6171 - DNA, 117 bp, Neisseria gonorrhoeae
ttgatttatcgtgtttccttttcggttgaacctcagccctttggggcggtaaaatcagactttatttgggaggggcgcaaccccttccgaatcaggacggcacatagggcggtgctt

SEQ ID NO: 6172 - protein, 39 aa, Neisseria gonorrhoeae
LIYRVSFSVEPQPFGAVKSDFIWEGRNPFRIRTAHRAVL

SEQ ID NO: 6173 - DNA, 195 bp, Neisseria gonorrhoeae
gtgcaggaatgtacgcgcacaaacgttaaacgcccgaataggattttaacgcaaattagcacactgatatcggtttttacttggaatttggaaaaatttacattcctccgggcgggcaggcaggttcagacggcatcgtcaggcaaaaggcggtgtcggaagacgggtaaagaaggggcgcgcaatccggattat

SEQ ID NO: 6174 - protein, 65 aa, Neisseria gonorrhoeae
VQECTRTNVKRPNRILTQISTLISVFTWNLEKFTFLRAGRQVQTASSGKRRCRKTGKEGARNPDY

SEQ ID NO: 6175 - DNA, 2079 bp, Neisseria gonorrhoeae
atgaaatcactcaaaaccttcctcatttggggcatagtggtactggtcggcttagcatcctttaccactctggccctcagccgaggcgaacaggtcagcgcggtatggatggttaccgccgccatatccgtttactgtatcgcctaccgtttttacagcctctacatcgccaaccgcgtgatgcggctcgatccgaaccgtctcacgcccgccgagcggcacaacgacggcttggactacgttccgacgcacaaaggcgtattgttcggacaccactttgccgcgattgccggcgcgggccctttggtcggtccggttttggcggcgcaaatgggttatctacccggtactttgtggattatcttcggcgtggtatttgccggcgcggtacaggatatgacggtcttgttcgtctctatgcgccgcgacggtaagtctttgggcgatattgtgaaacaggaactcggcactgtccccggcgtgattgcctccatcggtattttgatgattatggtcatcattatggcggttttggcgttgattgtcgtaaaagcattggttcacagcccttggggtacgttcaccattgccgcaacgatgccgattgcgctgtttatgggtatttacacgcgccatatccgtccgggcaaaatcggcgagatttccatcgtcggctttattttgctgatgttggcggtaatttacggcgaagatgtggcgaaaagctccatcgggcattggtttgaccttgacggcatccagctcacttgggcgattatgatttacggtttcgtggcttcggttttgccggtctggctcttgctgaccccgcgcgactatctctccaccttcctgaaaatcggtacgattgcggccttggctttgggtatcgtcatcgtcaatcccgctttgcaaatgcctgcggttacccactttatcgacggttcgggcccggtattctcaggcacattgttcccgttcttgttcattaccatcgcctgcggtgcggtttcgggcttccacgcactgatttcttccggcaccacgccgaaaatgctggaaaacgaaacccacgtccgtatgatcggttacggcggtatgttgatggaaagtttcgtggcgattatggcgcttgccgccgccgcatcgctcgatcccggcgtgtatttcgcgatgaacagccccgccgcactgatcggtacggatgccaacaccgccgccgaagtaattaccaccaagctgaacttccctgtcgatgccgcaaccctgttgcacaccgctaaggaagtgggcgaaaacaccatcttgtcccgcacaggcggtgcgcctaccctcgcagtcggtatggcgcacattatgagccgtctgattccgggcgaggcgatgatggcattctggtatcacttcgccctgttgtttgaagccttgttcatcctgaccgccgtcgatgccggtacgcgcgtcgcacgttttatgattcaagacttgggcagcatcttctacaaacctttcggcaacaccgactccatccccgccaacctgattgcgaccttcttcgccgtggcattgtggggctacttcctctacaccggcgtaaccgacccgctgggcggcatcaactcgctctggcctttattcggcatcgccaaccaaatgctggcaggcgtagccttgattatgtgtgccgttgtgctgattaagatgaaacgcgaccgttatgtctgggtggcactcgttcctgccgtcggcgtactgcttgtaacctgctacgccggtctgcaaaaactgttccacaacgacccgcgcgccagcttccttgcccacgcaggcaaatacagcgacacattggctaaaaacgaagtccttgcgcccgctaaagacatcggcgaaatggcgcaaatcatcttcaacgacaagattaatgccggtctgaccatcctcttcttgtcggttgtcgtgactgttgccgcgtacggtttgcgtaccgccctcaaagcacgcaaagtcggctggccgaccgccaaagaaatcccggcggtgtaccgcgacggcaaacaaccggaggaacaaagtgaagca

SEQ ID NO: 6176 - protein, 693 aa, Neisseria gonorrhoeae
MKSLKTFLIWGIVVLVGLASFTTLALSRGEQVSAVWMVTAAISVYCIAYRFYSLYIANRVMRLDPNRLTPAERHNDGLDYVPTHKGVLFGHHFAAIAGAGPLVGPVLAAQMGYLPGTLWIIFGVVFAGAVQDMTVLFVSMRRDGKSLGDIVKQELGTVPGVIASIGILMIMVIIMAVLALIVVKALVHSPWGTFTIAATMPIALFMGIYTRHIRPGKIGEISIVGFILLMLAVIYGEDVAKSSIGHWFDLDGIQLTWAIMIYGFVASVLPVWLLLTPRDYLSTFLKIGTIAALALGIVIVNPALQMPAVTHFIDGSGPVFSGTLFPFLFITIACGAVSGFHALISSGTTPKMLENETHVRMIGYGGMLMESFVAIMALAAAASLDPGVYFAMNSPAALIGTDANTAAEVITTKLNFPVDAATLLHTAKEVGENTILSRTGGAPTLAVGMAHIMSRLIPGEAMMAFWYHFALLFEALFILTAVDAGTRVARFMIQDLGSIFYKPFGNTDSIPANLIATFFAVALWGYFLYTGVTDPLGGINSLWPLFGIANQMLAGVALIMCAVVLIKMKRDRYVWVALVPAVGVLLVTCYAGLQKLFHNDPRASFLAHAGKYSDTLAKNEVLAPAKDIGEMAQIIFNDKINAGLTILFLSVVVTVAAYGLRTALKARKVGWPTAKEIPAVYRDGKQPEEQSEA

SEQ ID NO: 6177 - DNA, 192 bp, Neisseria gonorrhoeae
gtgaagcataagctcgcgtcttggtggaaaaccatcaagctgacggcaaacttgatggcaggcgtgcccgattatgaaaactacgttgcacaacaacgtaaacataatcccaacgcccccgtgatgaacaagctgcaatttcaagactattgccgcaaacgccgctgcggcgcaaacggcggacgctgctgt

SEQ ID NO: 6178 - protein, 64 aa, Neisseria gonorrhoeae
VKHKLASWWKTIKLTANLMAGVPDYENYVAQQRKHNPNAPVMNKLQFQDYCRKRRCGANGGRCC

SEQ ID NO: 6179 - DNA, 774 bp, Neisseria gonorrhoeae
atgaccctcatccacccgaccgccgtcatcgaccccaaagccgaactcgactccggcgtcaaagtcggcgcgtacaccgtcatcggccccaacgtccgaatcggtgcgaatacagaaatcggtccgcacgccgtcatcaacggccacaccaccatcggcgaaaacaaccgcattttccaatttgccagcctcggcgaaattccgcaggacaaaaaataccgcgacgagccgaccaagctgattatcggcaacggcaacaccatccgcgaattcaccacctttaatttaggcacggtaaccggcatcggcgaaacccgtatcggcgacgacaactggattatggcgtactgccacctcgcgcacgactgcgtggtcggcaaccacaccattttcgccaacaacgcctcgcttgccggacacgttaccgtcggcgactacgtcgttttgggcggctacacgctggtcttccaattctgccgcatcggcgactacgccatgaccgccttcgccgcaggcgtacacaaagacgtgccgccctactttatggcatcgggctaccgcgccgaaccggccggcctaaacagcgaaggtatgcgccgcaacggttttaccgcagaacagatttccgccgtcaaagacgtatacaaaaccctctaccatcgcggcattccgtttgaagaagccaaggcggacattctccgccgcgccgaaacccaagccgagcttgccgtatttcaagacttcttcgcacaatcgacgcgcggcatcatccgc

SEQ ID NO: 6180 - protein, 258 aa, Neisseria gonorrhoeae
MTLIHPTAVIDPKAELDSGVKVGAYTVIGPNVRIGANTEIGPHAVINGHTTIGENNRIFQFASLGEIPQDKKYRDEPTKLIIGNGNTIREFTTFNLGTVTGIGETRIGDDNWIMAYCHLAHDCVVGNHTIFANNASLAGHVTVGDYVVLGGYTLVFQFCRIGDYAMTAFAAGVHKDVPPYFMASGYRAEPAGLNSEGMRRNGFTAEQISAVKDVYKTLYHRGIPFEEAKADILRRAETQAELAVFQDFFAQSTRGIIR

SEQ ID NO: 6181 - DNA, 666 bp, Neisseria gonorrhoeae; identical to SEQ ID NO: 19

SEQ ID NO: 6182 - protein, 222 aa, Neisseria gonorrhoeae; identical to SEQ ID NO: 20

SEQ ID NO: 6183 - DNA, 138 bp, Neisseria gonorrhoeae
atgccgtctgaagcccgtttcccgcttcagacgccattttgtacggatgacccaatatcttccgtttttttactttcaataatcagatatgcccgaaccaccgtccgacaacgataccgtaccgcatccgcgcaatgt

SEQ ID NO: 6184 - protein, 46 aa, Neisseria gonorrhoeae
MPSEARFPLQTPFCTDDPISSVFLLSIIRYARTTVRQRYRTASAQC

SEQ ID NO: 6185 - DNA, 312 bp, Neisseria gonorrhoeae
atgagaaaaagccgtctaagccggtataaacaaaataaactcattgaactgtttgtcgcaggcgtaactgcaagaacagcaacagagcctgacagcattgtttatacggattgttatcgtcgctatgatgtattggatgcaggcgaatttagccatttccgtatcaatcacagcacacattttgccgaacgacaaaaccatattaatggaattgggaacttttggaaccgggcaaaacgtcatttacgcaagtttgacggcattcccaaagagcattttgagccgtatttaaaggagtgcgaacggcgtttt

SEQ ID NO: 6186 - protein, 104 aa, Neisseria gonorrhoeae
MRKSRLSRYKQNKLIELFVAGVTARTATEPDSIVYTDCYRRYDVLDAGEFSHFRINHSTHFAERQNHINGIGNFWNRAKRHLRKFDGIPKEHFEPYLKECERRF

SEQ ID NO: 6187 - DNA, 789 bp, Neisseria gonorrhoeae
atgcgggcacggctgctgatacctattcttttttcagtttttattttatccgcctgcgggacactgacaggtattccatcgcatggcggaggcaaacgcttcgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgcggcgaatacataaacagccctgccgtccgcaccgattacacctatccgcgttacgaaaccaccgctgaaacaacatcaggcggtttgacgggtttaaccacttctttatctacacttaatgcccctgcactctcgcgcacccaatcagacggtagcggaagtaggagcagtctgggcttaaatattggcgggatgggggattatcgaaatgaaaccttgacgaccaacccgcgcgacactgcctttctttcccacttggtgcagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaacccaaaaccaatgcgtttgaagctgcctataaagaaaattacgccattgtggatggggccgta

SEQ ID NO: 6188 - protein, 263 aa, Neisseria gonorrhoeae
MRARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSRSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYAIVDGAV

SEQ ID NO: 6189 - DNA, 111 bp, Neisseria gonorrhoeae; identical to SEQ ID NO: 421

SEQ ID NO: 6190 - protein, 37 aa, Neisseria gonorrhoeae; identical to SEQ ID NO: 422

SEQ ID NO: 6191 - DNA, 99 bp, Neisseria gonorrhoeae
atggatatgacgggcctcaaggcggcggttatccgccccccggaggggcaagggatatatacagctaccatatcaaaggaacttcaaccaaaacaaaga

SEQ ID NO: 6192 - protein, 33 aa, Neisseria gonorrhoeae
MDMTGLKAAVIRPPEGQGIYTATISKELQPKQR

SEQ ID NO: 6193 - DNA, 1353 bp, Neisseria gonorrhoeae
ttgctgcaaatccccattagtcatgcgaacggtttggatgcccgtttgcgcgatgatatgcaggcaaaacactacgaaccgggtggcaaataccatctgtttggtaatgctcgcggcagtgttaaaaatcgggtttgcgccgtccaaacatttgatgcaactgcggtcggccccatactgcctattacacacgaacggacaggatttgaaggtgttatcggctatgaaacccatttttcaggacacggacacgaagtacacagtccgttcgataatcatgattcaaaaagcacttctgatttcagcggcggcgtagacggcggttttaccgtttaccaacttcatcggacagggtcggaaatccatccggaggatggatatgacgggcctcaaggcggcggttatccgccccccggaggggcaagggatatatacagctaccatatcaaaggaacttcaaccaaaacaaagataaacactgttccgcaagcccctttttcagaccgctggctaaaagaaaatgccggtgccgcttccggttttctcagccgtgcggatgaagcaggaaaactgatatgggaaaacgaccccgataaaaattggcgggctaaccgtatggatgatattcgcggcatcgtccaaggtgcggttaatccttttttaacgggttttcagggattgggagttggggcaattacagacagtgcggtaagcccggtaacctatgcggcagcacggaaaactttacagggtattcacaatttaggaaatttaagtccggaagcacaacttgcggccgcaaccgcattacaagacagtgcctttgcggtaaaagacagtatcaactctgccagacaatgggctgatgcccatccgaatataacagcaacagcccaaactgcccttgccgtaacagaggccgcaactacggtttggggaggtaaaaaagtagaacttaacccggccaaatgggattgggttaaaaataccggctataaaaaacctgctgcccgccatatgcagactgtagatggggagatggcaggggggaataaaccgctggaatcaaaaaatactgtaacaacgaataatttttttgaaaataccggttatacagagaaagtattaaggcaagcatcgaatggtgattatcatggttttccgcaatcagtagatgctttttctgaaaatggaacagtaatacaaatagttggcggagataatattgtaaggcataaactttatatccctggatcttataaaggaaaagatggaaattttgaatatatcagagaagcagatggaaaaattaatcatagattatttgtccctaaccaacaacttcctgaaaaa

SEQ ID NO: 6194 - protein, 451 aa, Neisseria gonorrhoeae
LLQIPISHANGLDARLRDDMQAKHYEPGGKYHLFGNARGSVKNRVCAVQTFDATAVGPILPITHERTGFEGVIGYETHFSGHGHEVHSPFDNHDSKSTSDFSGGVDGGFTVYQLHRTGSEIHPEDGYDGPQGGGYPPPGGARDIYSYHIKGTSTKTKINTVPQAPFSDRWLKENAGAASGFLSRADEAGKLIWENDPDKNWRANRMDDIRGIVQGAVNPFLTGFQGLGVGAITDSAVSPVTYAAARKTLQGIHNLGNLSPEAQLAAATALQDSAFAVKDSINSARQWADAHPNITATAQTALAVTEAATTVWGGKKVELNPAKWDWVKNTGYKKPAARHMQTVDGEMAGGNKPLESKNTVTTNNFFENTGYTEKVLRQASNGDYHGFPQSVDAFSENGTVIQIVGGDNIVRHKLYIPGSYKGKDGNFEYIREADGKINHRLFVPNQQLPEK

SEQ ID NO: 6195 - DNA, 90 bp, Neisseria gonorrhoeae
atggaaattttgaatatatcagagaagcagatggaaaaattaatcatagattatttgtccctaaccaacaacttcctgaaaaatagtaga

SEQ ID NO: 6196 - protein, 30 aa, Neisseria gonorrhoeae
MEILNISEKQMEKLIIDYLSLTNNFLKNSR

SEQ ID NO: 6197 - DNA, 483 bp, Neisseria gonorrhoeae; identical to SEQ ID NO: 21

SEQ ID NO: 6198 - protein, 161 aa, Neisseria gonorrhoeae; identical to SEQ ID NO: 22

SEQ ID NO: 6199 - DNA, 2148 bp, Neisseria gonorrhoeae
atgctcaccgatttagaaaaaaacgccatccgcgaccattaccaaaatatcggcaaaaacctgcccggtttccgtccgcgtgcttcgcagcgggaaatgattgcggcggttgccaacgctttttcgcggacgttgacgcgcgaagaaggcggcgagccgcccaagcgcgagggcgaaagcattgccgtaatcgaagggccgaccggcgtgggcaaatcgcttgcctacctgcttgcgggcggcatcatggcgcaaacacgcggcaagcggctgattgtgagcagcgcgacggttgccttgcaggagcagttggtagaccgcgacctgccgtttctggtcgaaaaaagcggtttggaactgaccttcgcacttgccaaagggcgcggccgctatctctgcccctacaaactctatcaactgacgcaaagcaacgcccagcaaaacctgctcggctttgaagcccccgccgtcttgtgggacagcaaacccaagccggaagaattgaagctgctgcgcgacatcgccgacgaattttccgcccgacggttcaacggcgaccgcgacgcttggccggaaaaaatcgatgacgcgatttggctcaaagtgaccaacgaccgccacggctgcctgaaagccgcctgtcccaaccgtccggaatgccctttttacctggcacgcgatatgttggaaaccgtcgatgtcgttgttgccaaccacgatcttctgcttgccgacatcagcatgggcggcggcgtgattctgcctgcgcccgaaaacagtttctattgcatagacgaagcgcaccacctgcccaaaaaagccctcagccgttttgccgccgaacattcatggaatattgccgtttggacgctggaaaaactgccgcagcttaccggcaaaattgccgcgcttaccgataaagccgaacttgccaaccttgccgacgaagccgccgcatccttgctcgacagcctgcacgaatggcaattccatttggcggaagagccgtctttaagtatggggctgtctgaaaacgacagacgaaccaacagcgaaccgacttggctgtgggaagacggcaaaatccccgaaggcctcgaaaccaccgtttccaatacggccattgctgcacgcagcctgctcaaacacgttgtcgggctgaacgatgcgctttccgccgcacgccgcgaaaaagaacaggacggtgcgctcatcgaccgcctgaccggcgagttcggcctttttatcgcccgtatcgaacaaatcagtgcggtttgggatttgctctccactgtttccattgagggcgaggagccgttggcgaaatggatagcccgccgtgccgacgacaaaaacgactatattttcaatgccagccccatcagcagcgcgtcccaccttgccaacagcctgtggcggcgcgcggcaggcgcggtgctgacttcggccaccctgcaatcgctcggcagcttcaacttgattttgcgccaaaccggcctgctgtggctgcccgaaaccaccaccctcgccctcaaaagcccctttgactttgaaaaacagggcgaactctacatcccctccatatacgccagccccaaagaccccgaagcccacaccgccgccgtcatcgaatggctgcccaagctgatttcgcccaccgaagccatcggcacactcgtcctgttttcctcgcgcaaacaaatgcaggatgtcgccctgcacctgcccggagactacctgccgctcttgctcgtacaaggcgaattacccaaagccgtcctcctgcaaaaacaccaccaagccatagaagaaggcaaagccagcatcatcttcggactcgacagcttcgccgaagggctcgacctgcccggcaccgcctgcgtgcaagtcatcatcgccaaactccccttcgccatgcccgacaaccccatcgaaaaaacccaaaaccgttggatagaacaacgcggcggcaaccccttcatcgaaatcaccgtccccgaagccggcatcaaactcatccaggccgtcggccgcctcatccgcaccgaacaagactacggccgcgtaaccatcctcgacaaccgcatcaaaacgcagcggtacggccaacaattattggccggcctgccaccgtttaaaaggataggg

SEQ ID NO: 6200 - protein, 716 aa, Neisseria gonorrhoeae
MLTDLEKNAIRDHYQNIGKNLPGFRPRASQREMIAAVANAFSRTLTREEGGEPPKREGESIAVIEGPTGVGKSLAYLLAGGIMAQTRGKRLIVSSATVALQEQLVDRDLPFLVEKSGLELTFALAKGRGRYLCPYKLYQLTQSNAQQNLLGFEAPAVLWDSKPKPEELKLLRDIADEFSARRFNGDRDAWPEKIDDAIWLKVTNDRHGCLKAACPNRPECPFYLARDMLETVDVVVANHDLLLADISMGGGVILPAPENSFYCIDEAHHLPKKALSRFAAEHSWNIAVWTLEKLPQLTGKIAALTDKAELANLADEAAASLLDSLHEWQFHLAEEPSLSMGLSENDRRTNSEPTWLWEDGKIPEGLETTVSNTAIAARSLLKHVVGLNDALSAARREKEQDGALIDRLTGEFGLFIARIEQISAVWDLLSTVSIEGEEPLAKWIARRADDKNDYIFNASPISSASHLANSLWRRAAGAVLTSATLQSLGSFNLILRQTGLLWLPETTTLALKSPFDFEKQGELYIPSIYASPKDPEAHTAAVIEWLPKLISPTEAIGTLVLFSSRKQMQDVALHLPGDYLPLLLVQGELPKAVLLQKHHQAIEEGKASIIFGLDSFAEGLDLPGTACVQVIIAKLPFAMPDNPIEKTQNRWIEQRGGNPFIEITVPEAGIKLIQAVGRLIRTEQDYGRVTILDNRIKTQRYGQQLLAGLPPFKRIG

SEQ ID NO: 6201 - DNA, 300 bp, Neisseria gonorrhoeae
atgttaaatgaaatttttgaaatttattcgagacaaggggaatctttgataggaattggaattagagaagccgcattacccgtccccactgcaatagatatattaaatttatttataaatgaaagaatacttgtattggggggagatatttatatcaagaaagataattatttttatcaaacatatgataattggtattacgagggaagtaatttatttaacagtatcaacaaagcaatgcattatttatctcaaataaaattagagaatgcatacgtgtcttttgttttgaaatttatc

SEQ ID NO: 6202 - protein, 100 aa, Neisseria gonorrhoeae
MLNEIFEIYSRQGESLIGIGIREAALPVPTAIDILNLFINERILVLGGDIYIKKDNYFYQTYDNWYYEGSNLFNSINKAMHYLSQIKLENAYVSFVLKFI

SEQ ID NO: 6203 - DNA, 312 bp, Neisseria gonorrhoeae
atgcagactgtagatggggagatggcaggaggaaacaagccagttgttaaatctattagaccaactacgcgagatgaattacgtcaagcattgcaagaacaaggttttagacgtactggttcagatgcggctcaatatgaaacatggaaaggtcctgatggcgtgaaaatagatattcgtccaaatggagaggttataagaacccaaagagtgccgcgaaccgatggtgtacagggaaaatatccgcaacgacaagattatgaaggcaatccattgccaaataatcatcatcattctggatattttgtcaaa

SEQ ID NO: 6204 - protein, 104 aa, Neisseria gonorrhoeae
MQTVDGEMAGGNKPVVKSIRPTTRDELRQALQEQGFRRTGSDAAQYETWKGPDGVKIDIRPNGEVIRTQRVPRTDGVQGKYPQRQDYEGNPLPNNHHHSGYFVK

SEQ ID NO: 6205 - DNA, 123 bp, Neisseria gonorrhoeae
atggtgtacagggaaaatatccgcaacgacaagattatgaaggcaatccattgccaaataatcatcatcattctggatattttgtcaaatgaaaaaaaatatttttcacaatgtaagccttta

SEQ ID NO: 6206 - protein, 41 aa, Neisseria gonorrhoeae
MVYRENIRNDKIMKAIHCQIIIIILDILSNEKKYFSQCKPL

SEQ ID NO: 6207 - DNA, 183 bp, Neisseria gonorrhoeae
ttgaattttaaattagatacaaataatttcgtagattatgaggataaggaagatagcttgtttcccttgtttatacccgaaatagagctatataaataccaattttatagtgaaattattattgatgtagggattattataaaaatatctgctgaaacaattaattttgagccactgggaaaa

SEQ ID NO: 6208 - protein, 61 aa, Neisseria gonorrhoeae
LNFKLDTNNFVDYEDKEDSLFPLFIPEIELYKYQFYSEIIIDVGIIIKISAETINFEPLGK

SEQ ID NO: 6209 - DNA, 177 bp, Neisseria gonorrhoeae
gtgagcctattacaggacagtgcttttgcggtaaaagacggtatcaactctgccagacaatgggctgatgcccatccgaacattacagctactgcccaaactgcccttgccgtagcagaggccgcaggtacggtttggagaggtaaaaaagtagaacttaacccgactaaatgggat

SEQ ID NO: 6210 - protein, 59 aa, Neisseria gonorrhoeae
VSLLQDSAFAVKDGINSARQWADAHPNITATAQTALAVAEAAGTVWRGKKVELNPTKWD

SEQ ID NO: 6211 - DNA, 303 bp, Neisseria gonorrhoeae
atgcagactgtagacagggaaatggctgggggaaacaaatcattaaaaatagggacacaatctgttgaaaaatcaaccggtcgtacaatacctaataatttaaaggaacaattagcaatggaagaagttaaggcaaacccacagggcaaaactcctgcgagaatacctcctatgtccgatactaaaaatggttggttggcaaaagacggctgggttaagcgcgttcaaaatataaacaaagttgagatacattacattgaaaatacaagaaccggtgagaaaacagatttcaagtttaaggat

SEQ ID NO: 6212 - protein, 101 aa, Neisseria gonorrhoeae
MQTVDREMAGGNKSLKIGTQSVEKSTGRTIPNNLKEQLAMEEVKANPQGKTPARIPPMSDTKNGWLAKDGWVKRVQNINKVEIHYIENTRTGEKTDFKFKD

SEQ ID NO: 6213 - DNA, 321 bp, Neisseria gonorrhoeae
atgtttttagatgatgtaaatgtttttttagatgatttaaataccaatccaatcactgacgaatggtatatgtccaattttgccgataaacatattaaaattttggaaagttacgaagcctttgatattctaaaacaatttgttgattacatgattgaagaacatgatgaaaaatcagaatatgaaatcatggaaatattgagacaattaaaatatcaagcagataccaacgaaaaattttatacaaatacacagaaacagaaaattgtagaattatataaacaagaaattagtcaggatattttaaatgaaatctttaga

SEQ ID NO: 6214 - protein, 107 aa, Neisseria gonorrhoeae
MFLDDVNVFLDDLNTNPITDEWYMSNFADKHIKILESYEAFDILKQFVDYMIEEHDEKSEYEIMEILRQLKYQADTNEKFYTNTQKQKIVELYKQEISQDILNEIFR

SEQ ID NO: 6215 - DNA, 345 bp, Neisseria gonorrhoeae
atgagaaaaagccgtctaagccggtataaacaaaataaactcattgaactgtttgtcgcaggcgtaactgcaagaacagcaacagagcctgacagcattgtttatacggattgttatcgtcgctatgatgtattggatgcgggcgaatttagccatttccgtatcaatcacagcacacattttgccgaacgacaaaaccatattaatggaattgggaacttttggaaccgggcaaaacgtcatttacgcaagtttgacggcattcccaaagagcattttgagccgtatttaaaggagtgcgaacggcgttttaacaacagtgagataaaagttcttgttccattt

SEQ ID NO: 6216 - protein, 115 aa, Neisseria gonorrhoeae
MRKSRLSRYKQNKLIELFVAGVTARTATEPDSIVYTDCYRRYDVLDAGEFSHFRINHSTHFAERQNHINGIGNFWNRAKRHLRKFDGIPKEHFEPYLKECERRFNNSEIKVLVPF

SEQ ID NO: 6217 - DNA, 486 bp, Neisseria gonorrhoeae
atggcgttagctgttgcaacaacactttctgcctgcttaggcggcggcggaggcggcacttctgctcccgactttaatgcaggcggcaccggtatcggcagcaacagcagggcaacgatagcggaatcagcagcagtatcttacgccggtataaaaaacgaaatgtgcaaagacagaagcatgctctgtgccggtcgggatgacgttgcggttacagacagggatgccaaaatcaaagccccccgaatctgcataccggagacttttcaaacccaaatgaccaatattaagaatatgatcaacctcaaacctgcaattgaagcaggctatacaggacgcggggtagaggtaggtatcgtcgatacaggcgaatccgtcggcagcatatcctttcccgaactgtatggcagaaaagaacacggctataacgaaaattacaaaaacaaattacaaaaactatacggcgtatatgcggaaggaagcgcc

SEQ ID NO: 6218 - protein, 162 aa, Neisseria gonorrhoeae
MALAVATTLSACLGGGGGGTSAPDFNAGGTGIGSNSRATIAESAAVSYAGIKNEMCKDRSMLCAGRDDVAVTDRDAKIKAPRICIPETFQTQMTNIKNMINLKPAIEAGYTGRGVEVGIVDTGESVGSISFPELYGRKEHGYNENYKNKLQKLYGVYAEGSA

SEQ ID NO: 6219 - DNA, 243 bp, Neisseria gonorrhoeae
atgcggaaggaagcgcctgaagacagaggcggtaaagacattgaagcttctttggacaatgaggcccttatagagactgaagcaaagccgacggatatccgccatgtaaaagaaatcggacacatcgatgtggtctcccatattattggcgggcgttccgtggacggcagacctgcaggcggtattgcgcccgatgcgacgctacacataatgaatacgcatgatggaaccaagaacgagaaa

SEQ ID NO: 6220 - protein, 81 aa, Neisseria gonorrhoeae
MRKEAPEDRGGKDIEASLDNEALIETEAKPTDIRHVKEIGHIDVVSHIIGGRSVDGRPAGGIAPDATLHIMNTHDGTKNEK

SEQ ID NO: 6221 - DNA, 612 bp, Neisseria gonorrhoeae; identical to SEQ ID NO: 1953

SEQ ID NO: 6222 - protein, 204 aa, Neisseria gonorrhoeae; identical to SEQ ID NO: 1954

SEQ ID NO: 6223 - DNA, 207 bp, Neisseria gonorrhoeae
atgtctgcagccatccgcaatgcatgggtcaagctgggcgaacgtggcgtgcgcatcgtcaataacagttttggaacaacatcgagggcaggcactgccgaccatttccaaatagccaattcggaggagcagtaccgccaaacgttgctcgactattccggcggtgataaaacagatgagggtatccgcctgatgcaacagagcgat

SEQ ID NO: 6224 - protein, 69 aa, Neisseria gonorrhoeae
MSAAIRNAWVKLGERGVRIVNNSFGTTSRAGTADHFQIANSEEQYRQTLLDYSGGDKTDEGIRLMQQSD

SEQ ID NO: 6225 - DNA, 534 bp, Neisseria gonorrhoeae
ttgtgtgtcattgcctgtcgaaaagatgaaaaggatgtttttattacggatgtggtaggacaggttgccctaatcgctctgttgcatcaggcggataccctcatctgttttatcaccgccggaatagtcgagcaacgtttggcggtactgctcctccgaattggctatttggaaatggtcggcagtgcctgccctcgatgttgttccaaaactgttattgacgatgcgcacgccacgttcgcccagcttgacccatgcattgcggatggctgcagacattatttctcgttcttggttccatcatgcgtattcattatgtgtagcgtcgcatcgggcgcaataccgcctgcaggtctgccgtccacggaacgcccgccaataatatgggagaccacatcgatgtgtccgatttcttttacatggcggatatccgtcggctttgcttcagtctctataagggcctcattgtccaaagaagcttcaatgtctttaccgcctctgtcttcaggcgcttccttccgcatatacgccgta

SEQ ID NO: 6226 - protein, 178 aa, Neisseria gonorrhoeae
LCVIACRKDEKDVFITDVVGQVALIALLHQADTLICFITAGIVEQRLAVLLLRIGYLEMVGSACPRCCSKTVIDDAHATFAQLDPCIADGCRHYFSFLVPSCVFIMCSVASGAIPPAGLPSTERPPIIWETTSMCPISFTWRISVGFASVSIRASLSKEASMSLPPLSSGASFRIYAV

SEQ ID NO: 6227 - DNA, 1515 bp, Neisseria gonorrhoeae
ttgtctatctggcagataccgaccaatccggcgcaaacgaaaccgtacacatcaaaaggcggtctgcagctgggcgacaaaggtacgctgtacacacgtttgggcaaactgctgaaagtggacggtacggcgattaccgacggcaagctgtacatgtcggcacgcggcaagggggcaggctatctcaacagtaccggacgacatgttcccttcctgagtgccgccaaaatcgggcaggattattctttcttcaaaaatatcaaaaccgacggcggtctgctggcttccctcgacagcgtcgaaaaaacagcgggcagtgaaggcgacacgccgtcctattatgtccgtcgcggcaatgcggcacggactgcttcggcagcggcacattccgcgcccgccggtctgaaacacgccgtagaacagggcggcagcaatctggaaaacctgatggtcgagctggatgcctccgaatcatccgcaacacccgagacggttgaaactgcggtcgccgaccgcacagatatgccgggcatccgcctacggcgcacaactttccgcacagcggcagccgtacagcatgcgaataccgccgacggcgtacgcatcttcaacagtctcgccgctaccgtctatgccgacagtgccgccgcccatgccgatatgcagggacgccgcctgaaagccgtatcggacgggttggaccacaacggtacgggtctgcgcgtcatcgcgcaaacccaacaggacggtggaacgtgggaacagggcggtgtcgaaggcaaaatgcgcggcagtacccaaactatcggcattgccgcgaaaaccggcgaaaatacgacagcagccgccacactgggcataggacgcagcacatggagcgaaaacagtgcaaatgcaaaaaccgacagcattagtctgtttgcaggcatacggcacgatgtgggcgatatcggctatctcaaaggcctgttctcctacggacgctacaaaaacagcatcagccgcagcaccggtgcggatgaatatgcggaaggcagcgtcaacggcacgctgatgcagctgggcgcactgggtggtgtcaacgttccgtttgccgcaacgggagatttgacggttgaaggcggtctgcgccacgacctgctcaaacaggatgcattcgccgaaaaaggcagtgctttgggctggagcggcaacagcctcactgaaggcacactggtcggactcgcgggtctgaaactgtcgcaacccttgagcgataaagccgtcctgtctgcgacggcgggcgtggaacgcgacctgaacggacgcgactacgcggtaacgggcggctttaccggcgcggctgcagcaaccggcaagacgggtgcacgcaatatgccgcacacccgccgggttgccggtctgggggtggatgtcgaattcggcaacggctggaacggcttggcacgttacagctacaccggttccaaacagtacggcaaccacagcggacaaatcggcgtaggctaccggttc

SEQ ID NO: 6228 - protein, 505 aa, Neisseria gonorrhoeae
LSIWQIPTNPAQTKPYTSKGGLQLGDKGTLYTRLGKLLKVDGTAITDGKLYMSARGKGAGYLNSTGRHVPFLSAAKIGQDYSFFKNIKTDGGLLASLDSVEKTAGSEGDTPSYYVRRGNAARTASAAAHSAPAGLKHAVEQGGSNLENLMVELDASESSATPETVETAVADRTDMPGIRLRRTTFRTAAAVQHANTADGVRIFNSLAATVYADSAAAHADMQGRRLKAVSDGLDHNGTGLRVIAQTQQDGGTWEQGGVEGKMRGSTQTIGIAAKTGENTTAAATLGIGRSTWSENSANAKTDSISLFAGIRHDVGDIGYLKGLFSYGRYKNSISRSTGADEYAEGSVNGTLMQLGALGGVNVPFAATGDLTVEGGLRHDLLKQDAFAEKGSALGWSGNSLTEGTLVGLAGLKLSQPLSDKAVLSATAGVERDLNGRDYAVTGGFTGAAAATGKTGARNMPHTRRVAGLGVDVEFGNGWNGLARYSYTGSKQYGNHSGQIGVGYRF

SEQ ID NO: 6229 - DNA, 252 bp, Neisseria gonorrhoeae
ttgcggctgtttcttatgaaaagaaaaccctattccaattgcctgcttctattgtttcaagacttcttccaaagattcggcatcaatcagacgtatagcggattaacaaaaatcaggacaaggcggcgggccgcagacggtacaaatggtacggaaccgatccgcccggtgcttgggcgtcttagggaaccgttccctttgagccggggcggggcaacccgtaccggtttttgttcatccgccatattgtgt

SEQ ID NO: 6230 - protein, 84 aa, Neisseria gonorrhoeae
LRLFLMKRKPYSNCLLLLFQDFFQRFGINQTYSGLTKIRTRRRAADGTNGTEPIRPVLGRLREPFPLSRGGATRTGFCSSAILC

SEQ ID NO: 6231 - DNA, 156 bp, Neisseria gonorrhoeae
atggcggatgaacaaaaaccggtacgggttgccccgccccggctcaaagggaacggttccctaagacgcccaagcaccgggcggatcggttccgtaccatttgtaccgtctgcggcccgccgccttgtcctgatttttgttaatccgctatacgtc

SEQ ID NO: 6232 - protein, 52 aa, Neisseria gonorrhoeae
MADEQKPVRVAPPRLKGNGSLRRPSTGRIGSVPFVPSAARRLVLIFVNPLYV

SEQ ID NO: 6233 - DNA, 90 bp, Neisseria gonorrhoeae; identical to SEQ ID NO: 6041

SEQ ID NO: 6234 - protein, 30 aa, Neisseria gonorrhoeae; identical to SEQ ID NO: 6042

SEQ ID NO: 6235 - DNA, 168 bp, Neisseria gonorrhoeae
ttgccttcacttgccgcctgcgctgcggaagagaagagaaggttttttgcgggctggattcattttcggctccttattcggtttaaccggttaaaaaaaagattttcactgatgttgaagggcggattatatcgggttccgggcggtgtttcaacacaatatggcgga

SEQ ID NO: 6236 - protein, 56 aa, Neisseria gonorrhoeae
LPSLAACAAEEKRRFFAGWIHFRLLIRFNRLKKRFSLMLKGGLYRVPGGVSTQYGG

SEQ ID NO: 6237 - DNA, 687 bp, Neisseria gonorrhoeae
gtgcaggcggatttagcctacgccgccgaacgcattacccacgattatccggaaccaaccggtacaaaaaaagacaaaataagcacggtaagcgattatttcagaaacatccgtacgcattccatccaccccagggtgtcggtcggctacgacttcggcggctggaggatagcggcagattatgcccgttacagaaagtggaacaacagtaaatattccgtcaacacaaaaaaggtgaacgaaaacaagggcgaaaagataaacgtgacgcaatatctgaaggcggaaaatcaggaaaacggtacgttccacgccgtttcttctctcggcttgtccgccgtttacgatttcaaactcaacgacaaattcaaaccctatatcggtgcgcgcgtcgcctacggacacgtcagacacagcatcgattcgaccaaaaaaacaacagagtttcttaccgccgccggtcaggatggcggagcgcctacggtttataataacggaagtacgcaagacgcccatcaagaaagcgacagcatccgccgcgtgggcctcggcgtcatcgccggcgtcggtttcgacatcacgcccaacctgaccttggacgccgggtaccgctaccacaactggggacgcttggaaaacacccgcttcaaaacccacgaagcctcgttgggcatgcgctaccgcttc

SEQ ID NO: 6238 - protein, 229 aa, Neisseria gonorrhoeae
VQADLAYAAERITHDYPEPTGTKKDKISTVSDYFRNIRTHSIHPRVSVGYDFGGWRIAADYARYRKWNNSKYSVNTKKVNENKGEKINVTQYLKAENQENGTFHAVSSLGLSAVYDFKLNDKFKPYIGARVAYGHVRHSIDSTKKTTEFLTAAGQDGGAPTVYNNGSTQDAHQESDSIRRVGLGVIAGVGFDITPNLTLDAGYRYHNWGRLENTRFKTHEASLGMRYRF

SEQ ID NO: 6239 - DNA, 93 bp, Neisseria gonorrhoeae
atgccgtctgaaaccccgaaagcgtttcagacggcatcggttttttttaaagcggtatgttgtttgatcgatgcatcattttgtatagtggtt

SEQ ID NO: 6240 - protein, 31 aa, Neisseria gonorrhoeae
MPSETPKAFQTASVFFKAVCCLIDASFCIVV

SEQ ID NO: 6241 - DNA, 108 bp, Neisseria gonorrhoeae
atgtcgtggcggattataacgcgcccggcggcggggcaatacggcaaatgccgcgccaagcatcgggcattggcggaaccggggttcgggcgcgttaaaaatgccgtc

SEQ ID NO: 6242 - protein, 36 aa, Neisseria gonorrhoeae
MSWRIITRPAAGQYGKCRAKHRALAEPGFGRVKNAV

SEQ ID NO: 6243 - DNA, 1338 bp, Neisseria gonorrhoeae
atgaacaaacaacccctttccctcgccgtcgtgggacacaccaacaccggcaaaacctcgctcctgcgcaccctgttgcgcgacagcggcttcggcgaagtcagaaacgcaccgtccaccacacgccatgtcgaagaagccgccatcagcgacggcgcggacatgttggttttcctgtatgacacgcccggactcgaagacgcgggcggtgttttggaatggctggaaaaccatacggacaatcgttcagacggcatcgagcggctgcaacagtttctcggcagccacggcgcgcatcacgatttcaaccaagaagccaaagtgctgcggcaggttttgcaaagcgatatggcaatgtacgtcatcgacgcgcgcgaacccgtcctcgacaaatatcgggatgaattgaccatcctttcatggtgtgccaaaccggttatgcccgtgttcaactttaccggcggacagcttcccgaatcgtggacaaccatgctggcgaggagaaacctgcacgttttcgcagggttcgacaccgtcgcctttgattttgaaggcgaattgcgcctgtgggaaaacctcgccaccatgttgcccgaacgcagcacacttgaccgcctgacagccatgcgccggcgcgaatggcagcggctggacggcggagcgcgccgcgaaatcgccgatttcctgctcgatgccgccgccttcaggcaggaagtggacgaaaacgaggataccgccaccgtgctgcaaaccatgcaggcggaaatacgccaactcgaacggcagatgcagcagcggctgtttgccctttaccgtttctaccacagcgaaatcgacggcggcgactggatgccgcaagccttccgccaagacccgttcgacagcgaattgctcaaacaatacggcatccgcaccggcacgggcgcggcaaccggcgcgctcatcggcttggggctggacatcgccacactcggcggctcgctcggattgggtacggcaatcggcggctttttgggcggcatcctgcccaatacccgcaccatttccgacaaactcgccggccgtcaaaccctgcacaccgaccctgaaaccctgaccctgctcgccgcccgcgccctcgatctgctccacgtcctgcaaacgcgcggacacgcggcacagtcggatatcgagctgcacagccgcaaagccccgtgggatgccgccaaactcccgcccgaactcaacaaagcccgcagtcattggaaatggtcgtcgctcaatacgcaccgcccggaaaccagccgcgccgaacgcagggaatatgcggagaagatcgggatacgtttggcgggcaaa

SEQ ID NO: 6244 - protein, 446 aa, Neisseria gonorrhoeae
MNKQPLSLAVVGHTNTGKTSLLRTLLRDSGFGEVRNAPSTTRHVEEAAISDGADMLVFLYDTPGLEDAGGVLEWLENHTDNRSDGIERLQQFLGSHGAHHDFNQEAKVLRQVLQSDMAMYVIDAREPVLDKYRDELTILSWCAKPVMPVFNFTGGQLPESWTTMLARRNLHVFAGFDTVAFDFEGELRLWENLATMLPERSTLDRLTAMRRREWQRLDGGARREIADFLLDAAAFRQEVDENEDTATVLQTMQAEIRQLERQMQQRLFALYRFYHSEIDGGDWMPQAFRQDPFDSELLKQYGIRTGTGAATGALIGLGLDIATLGGSLGLGTAIGGFLGGILPNTRTISDKLAGRQTLHTDPETLTLLAARALDLLHVLQTRGHAAQSDIELHSRKAPWDAAKLPPELNKARSHWKWSSLNTHRPETSRAERREYAEKIGIRLAGK

SEQ ID NO: 6245 - DNA, 309 bp, Neisseria gonorrhoeae; identical to SEQ ID NO: 109

SEQ ID NO: 6246 - protein, 103 aa, Neisseria gonorrhoeae; identical to SEQ ID NO: 110

SEQ ID NO: 6247 - DNA, 714 bp, Neisseria gonorrhoeae
atgccgtctgaaggttcagacggcatcggaatcggcgaatcagaagcggtagcgcatgcccaacgaggcttcgtgggttttgaagcgggtgttttccaagcgtccccagttgtggtagcggtacccggcgtccaaggtcaggttgggcgtgatgtcgaaaccgacgccggcgatgacgccgaggcccacgcggcggatgctgtcgctttcttgatgggcgtcttgcgtacttccgttattataaaccgtaggcgctccgccatcctgaccggcggcggtaagaaactctgttgtttttttggtcgaatcgatgctgtgtctgacgtgtccgtaggcgacgcgcgcaccgatatagggtttgaatttgtcgttgagtttgaaatcgtaaacggcggacaagccgagagaagaaacggcgtggaacgtaccgttttcctgattttccgccttcagatattgcgtcacgtttatcttttcgcccttgttttcgttcaccttttttgtgttgacggaatatttactgttgttccactttctgtaacgggcataatctgccgctatcctccagccgccgaagtcgtagccgaccgacaccctggggtggatggaatgcgtacggatgtttctgaaataatcgcttaccgtgcttattttgtctttttttgtaccggttggttccggataatcgtgggtaatgcgttcggcggcgtaggc

SEQ ID NO: 6248 - protein, 238 aa, Neisseria gonorrhoeae
MPSEGSDGIGIGESEAVAHAQRGFVGFEAGVFQASPVVVAVPGVQGQVGRDVETDAGDDAEAHAADAVAFLMGVLRTSVIINRRRSAILTGGGKKLCCFFGRIDAVSDVSVGDARTDIGFEFVVEFEIVNGGQAERRNGVERTVFLIFRLQILRHVYLFALVFVHLFCVDGIFTVVPLSVTGIICRYPPAAEVVADRHPGVDGMRTDVSEIIAYRAYFVFFCTGWFRIIVGNAFGGVG

SEQ ID NO: 6249 - DNA, 567 bp, Neisseria gonorrhoeae
ttgcgcatccgtccctcgcccgcccttgtatgtctcaaatgggttaaactacgcacttcccgacttcccgtttcgggcaggggtgcaggtccgatttatatttcaataaaacaaggaaactttatgcagcacgaagaaggcaaccgccaacgccctcaaggcgaacttctcctgcgtaccgtcgctatgccgcgcgataccaatcccaaccaagacattttcggcggctggattatgtcgcaaatggatttgggcggcggcatattggcggcggaaatcgcgcgggggcgcatcgttaccgtcgccgttcaggaaatgaacttcatccgcccggtcaaggtcggcaacgtcgtctgctgctacgggcattgcgtccgcgtgggcaatacttccctccagcttaaagtcgaagtctgggtgaaaactttgatgaacgattgcgttaccgaagaccgccatctcgtaaccgaggcggtgttcacttatgtcgccatcgatgcggaaggcaatccgcgcccgattccgaaagaaggcaaccccaaattgtcgggcttattgcccaccccg

SEQ ID NO: 6250 - protein, 189 aa, Neisseria gonorrhoeae
LRIRPSPALVCLKWVKLRTSRLPVSGRGAGPIYISIKQGNFMQHEEGNRQRPQGELLLRTVAMPRDTNPNQDIFGGWIMSQMDLGGGILAAEIARGRIVTVAVQEMNFIRPVKVGNVVCCYGHCVRVGNTSLQLKVEVWVKTLMNDCVTEDRHLVTEAVFTYVAIDAEGNPRPIPKEGNPKLSGLLPTP

SEQ ID NO: 6251 - DNA, 846 bp, Neisseria gonorrhoeae
atgccgtctgaaactgtcttcagacggcattccgtatcatttgaaccaagacctgatgcgggaaaacagcgacatactctgtttttcaaagtcttcccgcacttcgggcacggctgtttttatgaccttcattcctgcaaaagtctgcgccacaggcataatttcaatcgtgttcacattcatatgcgccggccggcggtacagccacaatgcggtttccgcaatatcttcggggcggataaattccacaccctcatacacgcccgccaccctctcgttatcgcctttgaagcgcacgttggaaaactccgtattgccgcacaaacccggctcgatattggtaacgcggatgttcttatccgccagctctgcgcgcaaattcaggctaaactggcgcacaaacgccttggtcgccccgtaaacgttgctgccggcataagcataattgcctgcaatcgaacccaaattcatcacataaccgccgccgcgttccaccatttgcggcaaaatcttgcgcgtcaggaacgtcaaacccaaaacattggtttgaatcattgtttcccaatcttcaaaatccgccttgtccgccgtgtccaaacccaaagccagcccggcattgttgatgaggcagtcgatgtcggaaaattcatcggggatgccgttcaaggcgttttccaccgactcgcggcacgacacgtccatttccaaagggtaaaacaaagcacccaattcatccgccaaagcctgaagcctgtccgcacggcgcgccgcaccgataacgcggtatcccgccccgacaaacgtgcggcacatcgcttcgccgaagcctgccgaagcaccggtaat

SEQ ID NO: 6252 - protein, 282 aa, Neisseria gonorrhoeae
MPSETVFRRHSVSFEPRPDAGKQRHTLFFKVFPHFGHGCFYDLHSCKSLRHRHNFNRVHIHMRRPAVQPQCGFRNIFGADKFHTLIHARHPLVIAFEAHVGKLRIAAQTRLDIGNADVLIRQLCAQIQAKLAHKRLGRPVNVAAGISIIACNRTQIHHITAAAFHHLRQNLARQERQTQNIGLNHCFPIFKIRLVRRVQTQSQPGIVDEAVDVGKFIGDAVQGVFHRLAARHVHFQRVKQSTQFIRQSLKPVRTARRTDNAVSRPDKRAAHRFAEACRSTGN

SEQ ID NO: 6253 - DNA, 819 bp, Neisseria gonorrhoeae
atggctgttttaattaccggtgcttcggcaggcttcggcgaagcgatgtgccgcacgtttgtcggggcgggataccgcgttatcggtgcggcgcgccgtgcggacaggcttcaggctttggcggatgaattgggtgctttgttttaccctttggaaatggacgtgtcgtgccgcgagtcggtggaaaacgccttgaacggcatccccgatgaattttccgacatcgactgcctcatcaacaatgccgggctggctttgggtttggacacggcggacaaggcggattttgaagattgggaaacaatgattcaaaccaatgttttgggtttgacgttcctgacgcgcaagattttgccgcaaatggtggaacgcggcggcggttatgtgatgaatttgggttcgattgcaggcaattatgcttatgccggcagcaacgtttacggggcgaccaaggcgtttgtgcgccagtttagcctgaatttgcgcgcagagctggcggataagaacatccgcgttaccaatatcgagccgggtttgtgcggcaatacggagttttccaacgtgcgcttcaaaggcgataacgagagggtggcgggcgtgtatgagggtgtggaatttatccgccccgaagatattgcggaaaccgcattgtggctgtaccgccggccggcgcatatgaatgtgaacacgattgaaattatgcctgtggcgcagacttttgcaggaatgaaggtcataaaaacagccgtgcccgaagtgcgggaagactttgaaaaacagagtatgtcgctgttttcccgcatcaggtcttggttcaaa

SEQ ID NO: 6254 - protein, 273 aa, Neisseria gonorrhoeae
MAVLITGASAGFGEAMCRTFVGAGYRVIGAARRADRLQALADELGALFYPLEMDVSCRESVENALNGIPDEFSDIDCLINNAGLALGLDTADKADFEDWETMIQTNVLGLTFLTRKILPQMVERGGGYVMNLGSIAGNYAYAGSNVYGATKAFVRQFSLNLRAELADKNIRVTNIEPGLCGNTEFSNVRFKGDNERVAGVYEGVEFIRPEDIAETALWLYRRPAHMNVNTIEIMPVAQTFAGMKVIKTAVPEVREDFEKQSMSLFSRIRSWFK

SEQ ID NO: 6255 - DNA, 630 bp, Neisseria gonorrhoeae
gtgcggcacatcgcttcgccgaagcctgccgaagcaccggtaattaaaacagccattgtttttcctttctttctcgtttcccaaacctgtttcaggtatcataacacccttcagacggcatcgcgccggctgaaaacgacaacaaccgtaccaccacgacaggacacattcaacatgaaaacccaaatcagccttgccgcaaccgccctcgccctattcctttccgcctgcggaaacggcggcgcgcccgcacagcccaaaggcgaaatttccgaaaaccgcaccgccgcgttcaaatctatgatgcccgacttctcgcgtatgggcaaaatggtcaaaggcgaagagccttacgatgtcgaaaaattcaaacaggcggcggcggcgtttgccgaaagcagcaaaaaaccgttcacactttttgagtccgatccgcaaggcaacggccgcgccctgcctgccgtttggtcggatggtgcaaaatttgaagccgaaaaaacaaaattcgccgccgccgtcgaaaaactcaacgccgccgcccaaaccggcaaactggacgaaatcaaagccgcctacggcgaaaccggcgcaagctgcaaatcctgccacgacagtttccgcgcgcccgaa

SEQ ID NO: 6256 - protein, 210 aa, Neisseria gonorrhoeae
VRHIASPKPAEAPVIKTAIVFPFFLVSQTCFRYHNTLQTASRRLKTTTTVPPRQDTFNMKTQISLAATALALFLSACGNGGAPAQPKGEISENRTAAFKSMMPDFSRMGKMVKGEEPYDVEKFKQAAAAFAESSKKPFTLFESDPQGNGRALPAVWSDGAKFEAEKTKFAAAVEKLNAAAQTGKLDEIKAAYGETGASCKSCHDSFRAPE

SEQ ID NO: 6257 - DNA, 108 bp, Neisseria gonorrhoeae
ttgtatagtggtttaaatttaaatcaggacaaggcgacgaagccgcagacagtacaagaagtacggcaaggcgaggcaacgctgtaccggtttaaatttaaaccacta

SEQ ID NO: 6258 - protein, 36 aa, Neisseria gonorrhoeae
LYSGLNLNQDKATKPQTVQEVRQGEATLYRFKFKPL

SEQ ID NO: 6259 - DNA, 1869 bp, Neisseria gonorrhoeae
ttgatgcaagctgtccgatacaggcctgaaattgacggattgcgggccgtcgccgtgctatccgtcattattttccacctgaataaccgctggctgcccggaggattcctgggggtggacattttctttgtcatctcgggattcctcattaccaacatcattctttctgaaatacagaacggttctttttctttccgggatttttatacccgcaggattaagcggatttatcctgcttttattgcggccgtgtccctggcttcggtgattgcttctcaaatcttcctttacgaagatttcaaccaaatgaggaaaaccatagagctttctacggtttttttgtccaatatttatttggggttccgattggggtatttcgatttgagtgccgacgagaaccccgtactgcatatctggtctttggcggtagaggaacagtattacctcctgtatcctcttttgctgatattctgttacaaaaaaaccaaatcactacgggtgctgcgtaatatcagcatcatcctgtttctgattttgaccgcatcatcgtttttgccggccgggttttataccgacatcctcaaccaacccaatacttattacctttcgacactgaggtttcccgagctgttggtgggttcgctgttggcggtttacgggcaaacgcaaaacggcagacggcaaacagaaaatggaaaacggcagttgctttcattactctgtttcggcgcattgcttgtctgcctgttcgtgatcgacaaacacgatccgtttatcccgggaataaccctgctccttccctgcctgctgacggcgctgcttatccggagtatgcaatacgggacacttccgacccgcatcctgtcggcaagccccatcgtatttgtcggcaaaatctcttattccctatacctgtaccattggatttttattgccttcgcccattacattacaggcgacaaacagctcggactgcctgccgtatcggcggttgccgcgttgacggccggattttccctgttgagctattatttgattgaacagccgcttagaaaacggaagatgaccttcaaaaaggcatttttctgcctttatctcgccccgtccctgatgcttgtcggttacaacctgtattcaagagggatattgaaacaggaacacctccgcccgctgcccggcacgcccgttgctgcggaaaataattttccggaaaccgtcttgaccctcggcgactcgcacgccggacacctgcgggggtttctggattatgtcggcggcagggaagggtggaaagctaaaatcctgtccctcgattcggagtgtttggtttgggtggatgagaagctggcagacaacccgttgtgccgaaaataccgggatgaagttgaaaaagccgaagctgttttcattgcccaattctatgatttgaggatgggcggccagcccgtgccgagatttgaagcgcaatccttcctgatacccgggttcaaagcccgattcagggaaaccgtcaagaggatagccgccgtcaaacctgtatatgtttttgcaaacaatacatcaatcagccgttctcccttgagggaggaaaaattgaaaagatttgctataaaccaatacctccggcctattcgggctatgggcgacatcggcaagagcaatcaggcggtctttgatttggttaaagatattcccaatgtgcattgggtggacgcacaaaaatacctgcccaaaaacacggtcgaaatacacggacgctatctttacggcgaccaagaccacctgacctatttcggttcttattatatggggcgggaatttcacaaacacgaacgcctgctcaagcattcccgaggcggcgcattgcag

SEQ ID NO: 6260 - protein, 623 aa, Neisseria gonorrhoeae
LMQAVRYRPEIDGLRAVAVLSVIIFHLNNRWLPGGFLGVDIFFVISGFLITNIILSEIQNGSFSFRDFYTRRIKRIYPAFIAAVSLASVIASQIFLYEDFNQMRKTIELSTVFLSNIYLGFRLGYFDLSADENPVLHIWSLAVEEQYYLLYPLLLIFCYKKTKSLRVLRNISIILFLILTASSFLPAGFYTDILNQPNTYYLSTLRFPELLVGSLLAVYGQTQNGRRQTENGKRQLLSLLCFGALLVCLFVIDKHDPFIPGITLLLPCLLTALLIRSMQYGTLPTRILSASPIVFVGKISYSLYLYHWIFIAFAHYITGDKQLGLPAVSAVAALTAGFSLLSYYLIEQPLRKRKMTFKKAFFCLYLAPSLMLVGYNLYSRGILKQEHLRPLPGTPVAAENNFPETVLTLGDSHAGHLRGFLDYVGGREGWKAKILSLDSECLVWVDEKLADNPLCRKYRDEVEKAEAVFIAQFYDLRMGGQPVPRFEAQSFLIPGFKARFRETVKRIAAVKPVYVFANNTSISRSPLREEKLKRFAINQYLRPIRAMGDIGKSNQAVFDLVKDIPNVHWVDAQKYLPKNTVEIHGRYLYGDQDHLTYFGSYYMGREFHKHERLLKHSRGGALQ

SEQ ID NO: 6261 - DNA, 201 bp, Neisseria gonorrhoeae
ttgccgaatattaaaatcaattttaccgaaaatgtgccgccgcacatcaggcacaacgccgccgacgccgccgccaaacgcgggaaagccatttcccccttcctttcccgccgccgcgttatttcccctttcctttcccgccgccgcgttcaaacacgccaagatcgaacaaagcgcgaacaaagccgccaaaatatgcca

SEQ ID NO: 6262 - protein, 67 aa, Neisseria gonorrhoeae
LPNIKINFTENVPPHIRHNAADAAAKRGKAISPFLSRRRVISPFLSRRRVQTRQDRTKREQSRQNMP

SEQ ID NO: 6263 - DNA, 1464 bp, Neisseria gonorrhoeae
ttgcgcggggaatgtgcgcggctattatggcatattttggcggctttgttcgcgctttgttcgatcttggcgtgtttgaacgcggcggcgggaaaggaaaggggaaataacgcggcggcgggaaaggaagggggaaatggctttcccgcgtttggcggcggcgtcggcggcgttgtgcctgatgtgcggcggcacattttcggtaaaattgattttaatattcggcaactgtcggaatatctgctaaaattccgcattttccgcaccgggtttccgcaccgggacactcggggcgtatgttcaatttgtcggaatggagtttttagggatatggggttgaaaaaagtctgtttgaccgtgttgtgcctgattgttttttgcttcgggatattttatacgtttgaccgggtaaatcagggggaaaggaacgcggtttccctgctgaaggacaaactcttcaatgaagaggggaaacccgtcaatctgattttctgctataccatattgcagatgaaggtggcagaaaggattatggcgcagcatccgggggagcggttttatgtggtgctgatgtctgaaaacaggaatgaaaaatacgattattatttcaatcagataaaggataaggcggagcgggcgtattttttctacctgccctacggtttgaacaaatcgtttaatttcattccgacgatggcggagctgaaggtgaagtcgatgctgctgccgaaggtcaagcggatttatttggcgagtttggaaaaagtcagtattgccgcctttttgagcacttacccggatgcggaaatcaaaacctttgacgacggcacaaacaacctgatacgggagagcagctatttgggcggcgagtttgccgtaaacggggcgattaagcggaattttgcccgaatgatggtcggggattggagcatcgccaaaacccgcaatgcttccgacgagcattacacgatattcaagggtttgaaaaacattatggatgacggccgccgcaagatgacttacctgccgctgttcgatgcgtccgaactgaaggcgggggacgaaacgggcggcacggtgcggatacttttgggttcgcccgacaaagagatgaaggaaatttcggaaaaggcggcaaaaaatttcaacatacaatatgtcgcgccgcatccccgccagacctacgggctttccggcgtaaccgcgttaaattcgccctatgtcatcgaagactatattttgcgcgaaattaagaaaaacccgcatacgaggtatgaaatttatacctttttcagcggtgcggcgttgacgatgaaggattttcccaatgtgcacgtttacgcattgaaaccggcttcccttccggaagattattggctcaagcccgtttatgcgctgttccgtcaggccgacattccgattttggcatttgacgataaaaatcaatcgcatggtaaatcaaaa

SEQ ID NO: 6264 - protein, 488 aa, Neisseria gonorrhoeae
LRGECARLLWHILAALFALCSILACLNAAAGKERGNNAAAGKEGGNGFPAFGGGVGGVVPDVRRHIFGKIDFNIRQLSEYLLKFRIFRTGFPHRDTRGVCSICRNGVFRDMGLKKVCLTVLCLIVFCFGIFYTFDRVNQGERNAVSLLKDKLFNEEGKPVNLIFCYTILQMKVAERIMAQHPGERFYVVLMSENRNEKYDYYFNQIKDKAERAYFFYLPYGLNKSFNFIPTMAELKVKSMLLPKVKRIYLASLEKVSIAAFLSTYPDAEIKTFDDGTNNLIRESSYLGGEFAVNGAIKRNFARMMVGDWSIAKTRNASDEHYTIFKGLKNIMDDGRRKMTYLPLFDASELKAGDETGGTVRILLGSPDKEMKEISEKAAKNFNIQYVAPHPRQTYGLSGVTALNSPYVIEDYILREIKKNPHTRYEIYTFFSGAALTMKDFPNVHVYALKPASLPEDYWLKPVYALFRQADIPILAFDDKNQSHGKSK

SEQ ID NO: 6265 - DNA, 2223 bp, Neisseria gonorrhoeae
atgactcaaaaatccaccattgtttatacccataccgacgaagcccccgcgctggcgacccaatcgctgctgccgattgtgcaggcgtttgcccgccacgccgatattgatgtcaaaactgccgacatttccctgtccggccgcattttggcggcattccccgaatatctgaccgaagcgcagcgcgtacccgacgcgcttgccgaattgggcgaactggtgaaacaacccggtgcaaacgtaatcaaactgccgaacatcagcgcatccgtacctcaactgaccgccgcgattaaagaattgcagtctaaaggctttgccgttcccgactatcctgccgaccctcaaaccgatgaagaaaaagccgtacgcgaacgctacgaccgcatcaaaggcagcgcggtaaaccctgtcctgcgcgaaggcaactccgaccgccgcgcgcctaaagcggtgaaaaactttgccaaaaaaaatccgcacagcatgggcgcgtgggcgaaagactccaaaacccacgttgccaccatgcaaagcggcgactttttccataacgaacaatccgttaccgtacccgatgcgacttccgtatccatcgtgttcaccgacaaacaaggcaataaaaaagagctgcgcgagcctgttgccctgaaagccggcgaaatcattgacgcgaccgtaatgagcaaaaaagccctgctcgccttccttgccgaacaagtgaaagacgcaaaagctaaaggcgtattgttctcgctgcatatgaaagccacgatgatgaaagtgtccgacccgattatcttcggacacgccgtcaaagtgttcttcgcgcctgtatttgaaaaattcggcggcaaactggctgccgcaggcgtcaacgtcaacaacggcttcggcaacctgattgccaatctggacaagctggatgcggacacccgcgccgccgtcgaagctgaaatcgccgccgtttacgccgccaaccctgatttggcgatggtcgattccgacaaaggcatcaccaacctgcacgttcccagcgatgtcatcgttgatgcttctatgcctgcgatgatccgcaattccggccgtatgtgggacaaaaacggcaaagcgcaagacaccaaagccgtgattcccgacagcagctatgccggtgtttaccaagcaaccatcgatttctgccgcgaacacggcgcattcgatccgacaacaatgggtactgtgcccaacgtcggactgatggcgcaagcggcggaagaatacggctcacacaacaaaacctttgaaatcgaagccgacggtcaggttcaagtgattgatgcggcgggcaatgtcctgatgcagcacgacgttgaggcaggcggcatctggcgcatgtgccaaaccaaagacgctcccgtcaaagactgggtacaactcgccgtcaaccgcgcccgcctgagcaacacgcccgccgtgttctggctcgacgaaaaccgtccgcacgacaagagtctgctcgccaaagtcaaagcctaccttgccgaattggataccaacggcctctacatccgcgtcctcgcgcccgaagaagccgctaaattcagcttgggccgtctgaaaaacggcgaagacaccatttccgtaaccggcaacgtcctgcgcgattatctgaccgacttgttcccgattttggaactgggtaccagcgcgaaaatgctgtccatcgttccattgatgaacggcggcggtatgtttgaaaccggcgcgggcggttctgcaccgaaacacgtccaacagttcctcgaagaaaaccacctgcgttgggactcattgggcgaattcctcgcgcttgccgtatcgtttgaacatctggcgcaaaaaaccggcaacgccaaagcccaagtcctcgccgacactttggatgccgccaccgaaaaactgctgttgaacgacaaatcgcccaaacgcaaagcgggcgaactcgacaaccgcggcagccatttctacctcaccctctactgggcgcaagaattggcggcgcaagacaaagatgccgaactgaaagccgcatttgctccattggcagccgctttgactgccgacgaagccaaaatcgttgaagaactctctgccgtacaaggcaaagcggtcgacatcggcggctactacgcagccaatcctgaaaaagccgcacaagcgatgcgtccgagcgcaacctttaatcaagtactaaacgcctta

SEQ ID NO: 6266 - protein, 741 aa, Neisseria gonorrhoeae
MTQKSTIVYTHTDEAPALATQSLLPIVQAFARHADIDVKTADISLSGRILAAFPEYLTEAQRVPDALAELGELVKQPGANVIKLPNISASVPQLTAAIKELQSKGFAVPDYPADPQTDEEKAVRERYDRIKGSAVNPVLREGNSDRRAPKAVKNFAKKNPHSMGAWAKDSKTHVATMQSGDFFHNEQSVTVPDATSVSIVFTDKQGNKKELREPVALKAGEIIDATVMSKKALLAFLAEQVKDAKAKGVLFSLHMKATMMKVSDPIIFGHAVKVFFAPVFEKFGGKLAAAGVNVNNGFGNLIANLDKLDADTRAAVEAEIAAVYAANPDLAMVDSDKGITNLHVPSDVIVDASMPAMIRNSGRMWDKNGKAQDTKAVIPDSSYAGVYQATIDFCREHGAFDPTTMGTVPNVGLMAQAAEEYGSHNKTFEIEADGQVQVIDAAGNVLMQHDVEAGGIWRMCQTKDAPVKDWVQLAVNRARLSNTPAVFWLDENRPHDKSLLAKVKAYLAELDTNGLYIRVLAPEEAAKFSLGRLKNGEDTISVTGNVLRDYLTDLFPILELGTSAKMLSIVPLMNGGGMFETGAGGSAPKHVQQFLEENHLRWDSLGEFLALAVSFEHLAQKTGNAKAQVLADTLDAATEKLLLNDKSPKRKAGELDNRGSHFYLTLYWAQELAAQDKDAELKAAFAPLAAALTADEAKIVEELSAVQGKAVDIGGYYAANPEKAAQAMRPSATFNQVLNAL

SEQ ID NO: 6267 - DNA, 318 bp, Neisseria gonorrhoeae; identical to SEQ ID NO: 295

SEQ ID NO: 6268 - protein, 106 aa, Neisseria gonorrhoeae; identical to SEQ ID NO: 296

SEQ ID NO: 6269 - DNA, 150 bp, Neisseria gonorrhoeae
ttgttcaggttgtgtcaattactatataaaaatcatcggtttacgatgattttccgtaacgccctgcaacaaaccgcaatcggcagacgctttttatcaatgttttatggtattaatttatatggtcatttttgggatggggacttgcca

SEQ ID NO: 6270 - protein, 50 aa, Neisseria gonorrhoeae
LFRLCQLLYKNHRFTMIFRNALQQTAIGRRFLSMFYGINLYGHFWDGDLP

SEQ ID NO: 6271 - DNA, 204 bp, Neisseria gonorrhoeae
ttgacacaacctgaacaaaaaagaaccgccctgaatcagggcggttttgctttgcggcggaaacggcgggattcgactaaattttattttattgatttaaatacatttatttcttataaaaatttaatttaccataaaaacagccatatacaaaaatcttggagtaactactgcattacactattagaaggatgcagggtcatg

SEQ ID NO: 6272 - protein, 68 aa, Neisseria gonorrhoeae
LTQPEQKRTALNQGGFALRRKRRDSTKFYFIDLNTFISYKNLIYHKNSHIQKSWSNYCITLLEGCRVM

SEQ ID NO: 6273 - DNA, 144 bp, Neisseria gonorrhoeae
ttgttctttaacccattgggaaaaactaattttatttgcaccttatttgcacctttttttataaatataattcaaatatttaatttatatattaatttaattaaatattacatgaccctgcatccttctaatagtgtaatgcag

SEQ ID NO: 6274 - protein, 48 aa, Neisseria gonorrhoeae
LFFNPLGKTNFICTLFAPFFINIIQIFNLYINLIKYYMTLHPSNSVMQ

SEQ ID NO: 6275 - DNA, 720 bp, Neisseria gonorrhoeae
atgcgaccctcctatttcatttccgacctgcatttgagcgaaaaacaccccgaactgaccgaactgctgctgcgttttttacgttctgccgccgccgggcaggcgcgggcggtttatattttgggcgatttgtttgatttttgggtgggcgatgacgaagtttccgagttgaatacttcggttgcgcgggaaatcaggaaattgtccgacaaaggcgttgccgtgttctttgtcaggggcaaccgcgatttcctaatcggtcgggatttttgccggcaggcgggtatgacgctgctgccggattactcggttttggacttgttcggcagcaacaccctgatttgccacggcgacacattgtgcaccgacgacaaggcatacctgcgtttccgccgcatcgtgcattgcaggcggctgcaaaaactgttcctgatgctgcccctgaagtggcgcacgcgccttgccgccaaaatcaggcgtgtcagcaaaatggaaaaacaggtcaagcccgccgatattatggatgtcaatgccgcctttaccgcgcggcaggttcgcgcctttaacgcggaaaggctgatacacggacacacccaccgcgagcatatccatcacgaaaacggctttacccgcatcgttttgggcgactggcataacgactatgcttcaatcctccgcgtggacggggacggcgcggtattcgtgccgccggaagaatgc

SEQ ID NO: 6276 - protein, 240 aa, Neisseria gonorrhoeae
MRPSYFISDLHLSEKHPELTELLLRFLRSAAAGQARAVYILGDLFDFWVGDDEVSELNTSVAREIRKLSDKGVAVFFVRGNRDFLIGRDFCRQAGMTLLPDYSVLDLFGSNTLICHGDTLCTDDKAYLRFRRIVHCRRLQKLFLMLPLKWRTRLAAKIRRVSKMEKQVKPADIMDVNAAFTARQVRAFNAERLIHGHTHREHIHHENGFTRIVLGDWHNDYASILRVDGDGAVFVPPEEC

SEQ ID NO: 6277 - DNA, 144 bp, Neisseria gonorrhoeae
ggacaaggcgacgaagccgcagacagtacaagaagtacggcaaggcgaggcaacgctgtaccggtttaaatttaaaccactatagatttcagaagtatggcagtcggcagcattgatgatttctgccgcccgccacatccccat

SEQ ID NO: 6278 - protein, 22 aa, Neisseria gonorrhoeae
GQGDEAADSTRSTARRGNAVPV

SEQ ID NO: 6279 - DNA, 1407 bp, Neisseria gonorrhoeae
ttgtcaatttttgatgtcttttccgaacaggatgccgatatgatcaaccccatcgcctcgctttcccccctagacggccgttatgcccaatccgttgaagcattgcgcccgattttttcagagtacggactgatgaaggcgcgcgtcaaagtcgaattaaactggctcaaagccctggccgccgagccggagattgccgaagtgccgcccttcagtgccgaaacgcttgccgaaatcgacaaagtcatcgaaaacttttcattagaagacgcggccgccgtcaaagccatcgaagccacgaccaatcatgatgtcaaagccatcgaatattggctgaaaaaacgttttgccgaagtgccggaagtcgccgccgtgagcgagttcatccacttcgcctgcaccagcgaagacatcaacaacctgtcccacgccctgatgctgcaagaggcgcgcgaaaccgtcatcctgcccaaacttgccgaaatcatcggcaaactcaccgctatggcgcacgaccttgccgccgtcccgatgatgagccgcacccacggccagcccgccacaccgaccactttgggcaaagaaaccgccaatgtcgtgtaccgcctgcaacgccagttcaaaatccttcaggcgcaagaattcctcggcaaaatcaacggcgcggtcggcaactacaacgcccacatggccgcctatcccgatgtggattgggaaacacactgccgcaacttcgtcgaaatcagcctcggtctgaccttcaacccctacaccatccaaatcgagccgcacgactatatggcggagtttttccaaaccctcagccgcatcaacacgattctcatcgacttcagccgcgacgtttggggttatatttcattgggttatttcaaacaaaaagtcaaagcgggcgaagtcggctcttccaccatgccgcacaaagtcaaccccatcgactttgaaaactccgagggcaacctcggcatggcaaacgccgtattgggctttttggcggaaaaactgcccgtctcacgctggcagcgcgatttgaccgacagcaccgtattgcgcaatatgggcgtgggcgtgggctatgccgtgttgggtttcgccgcccacttgcgcggtctgaacaagctcgagccgaaccctgccgcgcttgccgccgatttggatgtcacttgggagctgctcgccgagccgattcaaaccgtaatgcgccgttacggtgtcgccaatccttacgaaaaactgaaagacctgacgcgcggtaaaggcggcatcacacccgaagtgctgaaaggctttatcggatcgctggaaattcccgccgaagccaaagccaaattgcttgagctgacccccgcgctgtatgtgggcaaggctgaagcgttggcgaaacggatt

SEQ ID NO: 6280 - protein, 469 aa, Neisseria gonorrhoeae
LSIFDVFSEQDADMINPIASLSPLDGRYAQSVEALRPIFSEYGLMKARVKVELNWLKALAAEPEIAEVPPFSAETLAEIDKVIENFSLEDAAAVKAIEATTNHDVKAIEYWLKKRFAEVPEVAAVSEFIHFACTSEDINNLSHALMLQEARETVILPKLAEIIGKLTAMAHDLAAVPMMSRTHGQPATPTTLGKETANVVYRLQRQFKILQAQEFLGKINGAVGNYNAHMAAYPDVDWETHCRNFVEISLGLTFNPYTIQIEPHDYMAEFFQTLSRINTILIDFSRDVWGYISLGYFKQKVKAGEVGSSTMPHKVNPIDFENSEGNLGMANAVLGFLAEKLPVSRWQRDLTDSTVLRNMGVGVGYAVLGFAAHLRGLNKLEPNPAALAADLDVTWELLAEPIQTVMRRYGVANPYEKLKDLTRGKGGITPEVLKGFIGSLEIPAEAKAKLLELTPALYVGKAEALAKRI

SEQ ID NO: 6281 - DNA, 117 bp, Neisseria gonorrhoeae
ttgattttgttgggggaatggttgactttgaacgtgtccacgtttataattcaattcatcggcgcatcgggtgccgatacgggaaaagccccaccgaagcggggcttgtacagggag

SEQ ID NO: 6282 - protein, 39 aa, Neisseria gonorrhoeae
LILLGEWLTLNVSTFIIQFIGASGADTGKAPPKRGLYRE

SEQ ID NO: 6283 - DNA, 174 bp, Neisseria gonorrhoeae
ttggcggcttctttatgccgtccgaaagcccttcagacggcatttttctttgattttgttgggggaatggttgactttgaacgtgtccacgtttataattcaattcatcggcgcatcgggtgccgatacgggaaaagccccaccgaagcggggcttgtacagggagtaggaaaa

SEQ ID NO: 6284 - protein, 58 aa, Neisseria gonorrhoeae
LAASLCRPKALQTAFFFDFVGGMVDFERVHVYNSIHRRIGCRYGKSPTEAGLVQGVGK

SEQ ID NO: 6285 - DNA, 240 bp, Neisseria gonorrhoeae
atgagcttcattttcctactccctgtacaagccccgcttcggtggggcttttcccgtatcggcacccgatgcgccgatgaattgaattataaacgtggacacgttcaaagtcaaccattcccccaacaaaatcaaagaaaaatgccgtctgaagggctttcggacggcataaagaagccgccaagtttgcggcttggcggcggtcgggctattttaagaactcttttcggatttgttctt

SEQ ID NO: 6286 - protein, 80 aa, Neisseria gonorrhoeae
MSFIFLLPVQAPLRWGFSRIGTRCADELNYKRGHVQSQPFPQQNQRKMPSEGLSDGIKKPPSLRLGGGRAILRTLFGFVL

SEQ ID NO: 6287 - DNA, 171 bp, Neisseria gonorrhoeae
ttgcctatggttaatgaaaaactggcagaaaaccgaaagcgttacgagcaaaaacgagtcattaaaaaagtctcgtttaatgcggaaacagaaaaagagcttttggaatatgcccaaaatctcgatttttcccaatgggttaaatcaatcataaaagaaaaaatcaaaaag

SEQ ID NO: 6288 - protein, 57 aa, Neisseria gonorrhoeae
LPMVNEKLAENRKRYEQKRVIKKVSFNAETEKELLEYAQNLDFSQWVKSIIKEKIKK

SEQ ID NO: 6289 - DNA, 198 bp, Neisseria gonorrhoeae
ttggttcggttttccattaacggctgtgccgttgtaagaataataaacgtggacacgttcaaagtcaattactttttgattttttcttttatgattgatttaacccattgggaaaaatcgagattttgggcatattccaaaagctctttttctgtttccgcattaaacgagacttttttaatgactcgtttttgctcg

SEQ ID NO: 6290 - protein, 66 aa, Neisseria gonorrhoeae
LVRFSINGCAVVRIINVDTFKVNYFLIFSFMIDLTHWEKSRFWAYSKSSFSVSALNETFLMTRFCS

SEQ ID NO: 6291 - DNA, 843 bp, Neisseria gonorrhoeae; identical to SEQ ID NO: 199

SEQ ID NO: 6292 - protein, 281 aa, Neisseria gonorrhoeae; identical to SEQ ID NO: 200

SEQ ID NO: 6293 - DNA, 210 bp, Neisseria gonorrhoeae
ttggatttgacgatgagtgctgaagagttttgcaggaaacagatcgcctattggctgaacgagagccgcaaggcatcagataacgccgatttgaaggcctttgagttcgccggacgggaaccggcggattatcgggaaatgttgaaacgctatgcccgcgtgaaaaatgccgtccgaagattcgggcggcattttccgtttaccttaccg

SEQ ID NO: 6294 - protein, 70 aa, Neisseria gonorrhoeae
LDLTMSAEEFCRKQIAYWLNESRKASDNADLKAFEFAGREPADYREMLKRYARVKNAVRRFGRHFPFTLP

SEQ ID NO: 6295 - DNA, 177 bp, Neisseria gonorrhoeae
ttggtttattgggctttggcggaggctttcggcatcccggatgcggagactttcgacccgcagcgttcggaatcggcaaggaggcgtttcgagctgtatttcggcctgccggccgacagtgatttgcgccgtatcacgcgtgaggatgcgccgcacctgaacaggcatttttggatt

SEQ ID NO: 6296 - protein, 59 aa, Neisseria gonorrhoeae
LVYWALAEAFGIPDAETFDPQRSESARRRFELYFGLPADSDLRRITREDAPHLNRHFWI

SEQ ID NO: 6297 - DNA, 504 bp, Neisseria gonorrhoeae
atgatgtatggaattgatttccggctcgtccccgtcccccgccatatcccgcggcaggcaataccccccggcaaacaacctgccgtcacggtccggcgcaggcgcaagcgtcagcttcccgtcgccctgcaccgcataaaccggcagccccgtttgcgccccgtcgcgccaacccggggcgcaaacatccgccgcctccggcgaaaccaacttcaggcacaccggtcagccgtcggacacaaaacggatactgtcgatttcatacgcataacccgccgcaaacccgcccgccgcataagcataaagcggccgccctttttccacatccgttacaaacgcatcgtccgaatgcagcagccggccgcgcaggcacgcctcgtgaaccgcatcgttcaaccatcccgacacctcttcgtcgctccaaaaatacggctcggccttatcattggcaagcacgcggaaacgcgcaatcaaagccttcaaattcattgcacgataccgaac

SEQ ID NO: 6298 - protein, 168 aa, Neisseria gonorrhoeae
MMYGIDFRLVPVPRHIPRQAIPPGKQPAVTVRRRRKRQLPVALHRINRQPRLRPVAPTRGANIRRLRRNQLQAHRSAVGHKTDTVDFIRITRRKPARRISIKRPPFFHIRYKRIVRMQQPAAQARLVNRIVQPSRHLFVAPKIRLGLIIGKHAETRNQSLQIHCTIPN

SEQ ID NO: 6299 - DNA, 135 bp, Neisseria gonorrhoeae
atgttcagccctaccgaaaccgacttcccggcaaacgcgcccttgtttgccgcctccataatccccggcccgccgcccgaaatgacggcaatacccgaatccgacagccgccgcgccagacggcaggcaaacgca

SEQ ID NO: 6300 - protein, 45 aa, Neisseria gonorrhoeae
MFSPTETDFPANAPLFAASIIPGPPPEMTAIPESDSRRARRQANA

SEQ ID NO: 6301 - DNA, 261 bp, Neisseria gonorrhoeae
atgaatttgaaggctttgattgcgcgtttccgcgtgcttgccaatgataaggccgagccgtatttttggagcgacgaagaggtgtcgggatggttgaacgatgcggttcacgaggcgtgcctgcgcggccggctgctgcattcggacgatgcgtttgtaacggatgtggaaaaagggcggccgctttatgcttatgcggcgggcgggtttgcggcgggttatgcgtatgaaatcgacagtatccgttttgtgtccgacggc

SEQ ID NO: 6302 - protein, 87 aa, Neisseria gonorrhoeae
MNLKALIARFRVLANDKAEPYFWSDEEVSGWLNDAVHEACLRGRLLHSDDAFVTDVEKGRPLYAYAAGGFAAGYAYEIDSIRFVSDG

SEQ ID NO: 6303 - DNA, 171 bp, Neisseria gonorrhoeae
atgatagatacggtcgcgccacacggcacgcccgccgatatacttgataaaaaccttatccatccaaccccccgccgccgtccggacggcattgtcaaatacagcaacgccgcaaaggcaaatccccgggcggcgtttcattccgcttacaactggccgaacttctcgccg

SEQ ID NO: 6304 - protein, 57 aa, Neisseria gonorrhoeae
MIDTVAPHGTPADILDKNLIHPTPRRRPDGIVKYSNAAKANPRAAFHSAYNWPNFSP

SEQ ID NO: 6305 - DNA, 336 bp, Neisseria gonorrhoeae
ttggttttcgaagacggccaggtgcgcgaggtgtcggccggggctgcggcaaagttgttgcgccacggcgatgtgtttgccgccgtcccgggcaaacgcgtggaaaaggcggatgatacggaggctttggaaaaggcgggcgcttcggaactcgaacgggaagcggcggcgtttgacgcggtgcaggatgtgatcctgcaaatcaaccggatgggcaaggacgagcttgaactgtatgcgaaggcgaattacggccagggtttggataagcgcaaatcggcggagaatttgcgtgaggctgtggttcggatggttcgtcagttcggtatcgtgcaa

SEQ ID NO: 6306 - protein, 112 aa, Neisseria gonorrhoeae
LVFEDGQVREVSAGAAAKLLRHGDVFAAVPGKRVEKADDTEALEKAGASELEREAAAFDAVQDVILQINRMGKDELELYAKANYGQGLDKRKSAENLREAVVRMVRQFGIVQ

SEQ ID NO: 6307 - DNA, 492 bp, Neisseria gonorrhoeae
ttgtcgagttgggggggttttatggctcggattcatgtgagaaacaatggcggcaaccgtttcggcggcgtgccttacggcaatctggcggcggagcattactgtatcgttgcgaagcaggacggtgcaatcttgggggcggatgcctacgggccgcccaaggatggcgatgtgttggcgctgggtgtcttggaacagggtttccgtttggatgacgcgcagattattgtgaagacggcgatgtcttccggtatcactgccgatgtcggctttgcgtatgcggacggtgcggatgatgcgcacgtgcctcaggatgcggcttattttgcttcgggcgcggactttgcgtctgccgggcgtatccgctgccagtctgccaaactggttacgctgcccaagcaggctttgctgacggttacgcttaaaggggcggaaaataagaaggccgccgatatcgatattttgatttacggcgagaagttcggccagttg

SEQ ID NO: 6308 - protein, 164 aa, Neisseria gonorrhoeae
LSSWGGFMARIHVRNNGGNRFGGVPYGNLAAEHYCIVAKQDGAILGADAYGPPKDGDVLALGVLEQGFRLDDAQIIVKTAMSSGITADVGFAYADGADDAHVPQDAAYFASGADFASAGRIRCQSAKLVTLPKQALLTVTLKGAENKKAADIDILIYGEKFGQL

SEQ ID NO: 6309 - DNA, 1293 bp, Neisseria gonorrhoeae; identical to SEQ ID NO: 201

SEQ ID NO: 6310 - protein, 431 aa, Neisseria gonorrhoeae; identical to SEQ ID NO: 202

SEQ ID NO: 6311 - DNA, 558 bp, Neisseria gonorrhoeae
ttgagggagcgcatcgaggagcttgagaagggggcggaaaaacccggagtggaaacggctgacggttccgataattcgttgttcggggatttttccgacgaggatgtgaaaaagggcgtggaaaagctgattcaggagaagctggcgggttatgaggcggacatgaagcggcaggaggcggcaaaggcgcattaccgcgaaatctatacggcgcaccccgatgcggattcgattgtggaaagccgcgagctggaggagtggctggccgggcagaacccgcttgtccgcaaggcgtttaatgacgcgcttaaggacgggactgccgccgaggtcatcggggcgttcgatatgtttaaggcggcaaaatccgccgccgaaccggaaaagcccgccgaaaagccgcctgccgggaagaatacgcccaatacgctgtcggatattccggcggggcgcgaccatacggcttcggacggcccgccggattatttgagcggcaacgcgctggcggaaaaactggcttccatgacggaagagcaggttgagaagtttttaaattct

SEQ ID NO: 6312 - protein, 186 aa, Neisseria gonorrhoeae
LRERIEELEKGAEKPGVETADGSDNSLFGDFSDEDVKKGVEKLIQEKLAGYEADMKRQEAAKAHYREIYTAHPDADSIVESRELEEWLAGQNPLVRKAFNDALKDGTAAEVIGAFDMFKAAKSAAEPEKPAEKPPAGKNTPNTLSDIPAGRDHTASDGPPDYLSGNALAEKLASMTEEQVEKFLNS

SEQ ID NO: 6313 - DNA, 93 bp, Neisseria gonorrhoeae
ttggtcttaccaatttatcttttaaccaaaatatcgggtgtgcgggatttgaacgtctttccaaacctcgacgcgccttatgatgcaaatgcc

SEQ ID NO: 6314 - protein, 31 aa, Neisseria gonorrhoeae
LVLPIYLLTKISGVRDLNVFPNLDAPYDANA

SEQ ID NO: 6315 - DNA, 159 bp, Neisseria gonorrhoeae
gaagtatggcagtcggcagcattgatgatttctgccgcccgccacatccccattcggacatttcattgtgacctccgcctctgcttttaaataattgcaaacaatttccgcagcttgaaccggcctgtcttcggtgaaaaaaccaaaagtatttttcaa

SEQ ID NO: 6316 - protein, 29 aa, Neisseria gonorrhoeae
EVWQSAALMISAARHIPIRTFHCDLRLCF

SEQ ID NO: 6317 - DNA, 630 bp, Neisseria gonorrhoeae
atggagaatgtaaaccgcgtgccggagcaggcacgttatgatgccgaatgcaggcaggcagacgaagcattggcggacgtgtttccggcagtcagtattttcggcagcgcgcgcacgccgcaggatcatgcggattatgcgtttgcctgccgtctggcgcggcggctgtcggattcgggtattgccgtcatttcgggcggcgggccggggattatggaggcggcaaacaagggcgcgtttgccgggaagtcggtttcggtagggctgaacattgccctgccgcacgagcagaaaccgaatccgtatcaggacatcgccttgcggttttcccgttttgccgaacgcaaggcagtgtttttccgctattcccaagcatatgtcgtgatgccgggcggcttcgggacgctggacgaattgtttgaaatcctgaccttggtgcagacgggcaaagtgccgccgcgtccggtcgttttggttggaaaggcgttttggtcgggcttggcggagtggataaacgcgcagcttttggcgcgcggtatgatttccgaaggggccgcttctttgttctccatatcggacgacgaagacgaaatcattgcgtatctgtcggaacacgggcttcagacggca

SEQ ID NO: 6318 - protein, 210 aa, Neisseria gonorrhoeae
MENVNRVPEQARYDAECRQADEALADVFPAVSIFGSARTPQDHADYAFACRLARRLSDSGIAVISGGGPGIMEAANKGAFAGKSVSVGLNIALPHEQKPNPYQDIALRFSRFAERKAVFFRYSQAYVVMPGGFGTLDELFEILTLVQTGKVPPRPVVLVGKAFWSGLAEWINAQLLARGMISEGAASLFSISDDEDEIIAYLSEHGLQTA

SEQ ID NO: 6319 - DNA, 171 bp, Neisseria gonorrhoeae
ttgccgacgggccggcgcattgccggacgcaacggcggaccctggcaaaccctgcaaggcagccgcatttgcatccgcccccgcatcaggggtcaaacccctgccgccttgggtcaaaccctgccgcacatcctgccgcacatcctgcgccaaacccttatcttccgtggg

SEQ ID NO: 6320 - protein, 57 aa, Neisseria gonorrhoeae
LPTGRRIAGRNGGPWQTLQGSRICIRPRIRGQTPAALGQTLPHILPHILRQTLIFRG

SEQ ID NO: 6321 - DNA, 6012 bp, Neisseria gonorrhoeae; identical to SEQ ID NO: 83

SEQ ID NO: 6322 - protein, 2004 aa, Neisseria gonorrhoeae; identical to SEQ ID NO: 84

SEQ ID NO: 6323 - DNA, 1416 bp, Neisseria gonorrhoeae; identical to SEQ ID NO: 85

SEQ ID NO: 6324 - protein, 472 aa, Neisseria gonorrhoeae; identical to SEQ ID NO: 86

SEQ ID NO: 6325 - DNA, 1212 bp, Neisseria gonorrhoeae
ttgttcggagggtttgcgatgggtttgtttgagccgtctgccggggatttttgggagatgaaggaaaaggaggaaaaagagaaggcccggaagggggcggaggagcgggagcgggcggcggcacaggcgcaccgtgccgatgcggtgcggcgtaccgttgcgaattatgaggccgggccggcgcgttatcggaatgtgatggatttgagccgtaacaatattgaggatggggcgcggcggttgcgccgggcgggtgctttcgaacggggtgcggatgccggtttggggttttcgggcggcgataaggcgctttcccccgatgcgcgggccggggcggatttcgcgcggcgcgatacgcgcccgacggatgcgggcggacggacgccgccgcctttgggatttgacgggaatgtgtatcggggcggcaagccggtgcgtgattttgacgcgcagcgtcctttggtgtctgccgggccggatgcgctgtcgcctgaggagcgggagctttataagagggcgactacgccttatgcgggggccttgaacggtcagttgacggcggcacagcttaatgcggcgcgcgggattgtggcggaacataataaaaatgcggcggtcagggaattgggcagggaaaggctggcggcggctgcggcggagaatgcggcgaaccgtgaggcggtgttgcagaaggggcggtttgatgcggcggttaaggcgaacgagggtgcgttgaaccgcgagatggcgcagaggaatgcggacagggcgtttgatgtgcagcaggccgagctggggatgaagcggcaggggtttgagatgaagcgtgaggcggatgcgctggagcttgaggataggaagcgcatcgccgatttgacgcgggcttatggttttgcgaagtcggacgggcagcgcggggagattgcgcggcagattgatgcgcttaacgggaagtttgagcggcaaggggagaagggctttgacccgaatgtgttcaagactgtcagttatgaggttgccgacccggatacgggcttgacggcgaagcgcgaggggattgtcgatttgcggacgggcaagcctttggatgtggagtttgcgggagagcgcgagaagcgttatgcggcgttgggctttaagccgaacggtcagaaaacggccggcggtaaaatcatttatgagaatgagaagggtgagaagagggttgagcaa

SEQ ID NO: 6326 - protein, 404 aa, Neisseria gonorrhoeae
LFGGFAMGLFEPSAGDFWEMKEKEEKEKARKGAEERERAAAQAHRADAVRRTVANYEAGPARYRNVMDLSRNNIEDGARRLRRAGAFERGADAGLGFSGGDKALSPDARAGADFARRDTRPTDAGGRTPPPLGFDGNVYRGGKPVRDFDAQRPLVSAGPDALSPEERELYKRATTPYAGALNGQLTAAQLNAARGIVAEHNKNAAVRELGRERLAAAAAENAANREAVLQKGRFDAAVKANEGALNREMAQRNADRAFDVQQAELGMKRQGFEMKREADALELEDRKRIADLTRAYGFAKSDGQRGEIARQIDALNGKFERQGEKGFDPNVFKTVSYEVADPDTGLTAKREGIVDLRTGKPLDVEFAGEREKRYAALGFKPNGQKTAGGKIIYENEKGEKRVEQ

SEQ ID NO: 6327 - DNA, 1419 bp, Neisseria gonorrhoeae; identical to SEQ ID NO: 297

SEQ ID NO: 6328 - protein, 473 aa, Neisseria gonorrhoeae; identical to SEQ ID NO: 298

SEQ ID NO: 6329 - DNA, 471 bp, Neisseria gonorrhoeae
atggcggggccgggtacgtgtgtagcaaccgcgtatccggccttttgcgcatatatacaagtcaaacaaggcaaacatcaggcacggcaaaaggctgcaatcggcctgcccgtttccggcggcggcaacccgcattacagacaacgacgccgggtatgtctcaatatgcggcgcaatagggaaaacttcacatccttggcgtgcaaaattcaagaaaaaggcgaacacgaaagcaagaatccggttgtttcggatgtattgaatgccataggatttacagccgtcggcattaagggaggcatatccggcgaatctgtttacaggagaatgggcggcggcgtattggcggaccggaaaacgcttaaaccctatatcatggaacttcgccgcctcaacaataacgacagattgttttgtgaatttgagcggcttgccgacaggcggggaaacaacccgtcaaagaccggaccg

SEQ ID NO: 6330 - protein, 157 aa, Neisseria gonorrhoeae
MAGPGTCVATAYPAFCAYIQVKQGKHQARQKAAIGLPVSGGGNPHYRQRRRVCLNMRRNRENFTSLACKIQEKGEHESKNPVVSDVLNAIGFTAVGIKGGISGESVYRRMGGGVLADRKTLKPYIMELRRLNNNDRLFCEFERLADRRGNNPSKTGP

SEQ ID NO: 6331 - DNA, 213 bp, Neisseria gonorrhoeae
gtgcaaacaaagttggtttttcccaatgggttaaagataaaatccgcgaaggggtgcaaaaacagcccgaccgccgccaagccgcaaacttggcggcttctttatgccgtccgaacaaggcttcagacggcatttgtttacacggcaggattaaacgggggcggatgtcaaggatgtcaggtttttaaatcatcccttgaaagaacgggcgca

SEQ ID NO: 6332 - protein, 71 aa, Neisseria gonorrhoeae
VQTKLVFPNGLKIKSAKGCKNSPTAAKPQTWRLLYAVRTRLQTAFVYTAGLNGGGCQGCQVFKSSLERTGA

SEQ ID NO: 6333 - DNA, 132 bp, Neisseria gonorrhoeae
gtgcaaaaacagcccgaccgccgccaagccgcaaacttggcggcttctttatgccgtccgaacaaggcttcagacggcatttgtttacacggcaggattaaacgggggcggatgtcaaggatgtcaggtttt

SEQ ID NO: 6334 - protein, 44 aa, Neisseria gonorrhoeae
VQKQPDRRQAANLAASLCRPNKASDGICLHGRIKRGRMSRMSGF

SEQ ID NO: 6335 - DNA, 90 bp, Neisseria gonorrhoeae
gtgaaaaaaccaaaagtatttttcaaaagaacatattgtcttattgaatattctgtgctgaaattaccggacactacaaaagtggtgttt

SEQ ID NO: 6336 - protein, 30 aa, Neisseria gonorrhoeae
VKKPKVFFKRTYCLIEYSVLKLPDTTKVVF

SEQ ID NO: 6337 - DNA, 801 bp, Neisseria gonorrhoeae; identical to SEQ ID NO: 2037

SEQ ID NO: 6338 - protein, 267 aa, Neisseria gonorrhoeae; identical to SEQ ID NO: 2038

SEQ ID NO: 6339 - DNA, 123 bp, Neisseria gonorrhoeae
ttgcatcataaggcgcgtcgaggtttggaaagacgttcaaatcccgcacacccgatattttggttaaaagataaattggtaagaccaattattatgcgtttgcacactttacgtaatcttatg

SEQ ID NO: 6340 - protein, 41 aa, Neisseria gonorrhoeae
LHHKARRGLERRSNPAHPIFWLKDKLVRPIIMRLHTLRNLM

SEQ ID NO: 6341 - DNA, 2265 bp, Neisseria gonorrhoeae
ttggaggctttattgatggggacggacgtaccggaaacaggcgtattgcccgataaaaacggcgaaccgctgactatcggggaataccggctgtttgtcggtgaaatgatgaaccaacctgcatggcgtgccgttgccgacaaggaaatggactacgccgacggcaggcagcttgacaacgagcttttacagaaacagcgcgagttgggcctgccccccgccgttgaaaacctgattaccccgaccctgctgtcggtacagggatatgaggcgacgatacggacggactggcgcgtgacggcggacggcgaaaccggcgggcgggacgtggcggacgcattgaacttcaaactcaaccgcgcggaacggcaaagccgtgccgacaaggcttgttcggacgcgttcagggggcagatagcctgcggcatcggctgggtggaggttacacgcaaccccaaccctttcgagtttccttatgagtgcggcgtcatccaccgcaacgccatccattgggatatgaaatcttacaaatacgacctgtccgatgcccgctggctgatacgccgccgctggctgctgccggaacgcctggcgcaattcttccctgaatatgccggacacttcaaagcgatggggcgcggcggttcggactggcgcatcagcggggaaatgcttgacggcggcggcaataccggactggcggacgcttggggtatttcggggcgcaacaccgtcagcgaagagttttggttcaatgaaaccacgcgcgaactggcggtggcggaagtatggtacaggcggtgggtaacggcagactgcctgcgcgacaaaaaaacagggcgcacggtggagtttgacggcgcaaacccaaaccatcgggagatggcggcaaacggcgcggtattgtttgccgcttccgtcccgcgtatgcgccgcgcctttgtcgtgggggatttggtcgtccgcgacgagccgaccccgtatccgcatcaaaagttcccttacgtcccgtttttcggattccgcgaggacaacaccggcatcccctacggatatgtccgcaatatgaaatacgcgcaggacaacctcaacagcaccaacagcaaattacgatggggtttgtcggcaatacgcacggtacgcaccaaaggcatagtcgatatgtcggacgaacagttccgccgcaatatcgcacgggtggacgcggacatcgtgctgaacaaaatagaggccgcccagccgggcgcgcgtttcgacgtcagccgcgatttcgaattgtcggcacagcattggcagatgcttcaagacagccgcgcgacaatacggcagatcagcgggattaccccgtcatttatgggcaaccggggcaacgccaccagcggcaggcaggaaagcatccaagtcgagcagtccaaccagtcgctggggctggttatggacaacttccgccagagccgctcattggtcggcgagttgctgcttgcgatgattatcgaggatttgggctcggacgagcaaaccgtcgtcatagaaggggacgccgtcacgcaagggcggacggtcgtcatcaacaggcctgaaaccgaccccgtaaccggcaaggcttatttgtccaacgacctgcaaaacatacggctgaaagtggctttggaagacgtgcccagcaccaactcctaccgcagccagcagctgggtgcgatgagcgaggcggtcaaatccctgccgcccgaatatcaggcggcggtgctgccgtttatggtgtccctgatggacatcccgtttaaagacaaagtgattgaaaaaatcaaagaagtccgagtgcaggaaacgcccgaacaaatcgaggcgcgtatcgcgcaggcggtgcaggacgcattggcaaaatccggcaacgacatcaaacggcgggaattggcgctcaaagaacaacgtaccgcgagcgaaatcaaggaaatcgaagcgcgggcggtacaaatcggcgtgcaggcggcttacgcggccatgcaggcgggcgggcagatagccgccatgccgcaaatcgcacccgttgccgacgcggtcatgcagggcgcgggatatatccggccggcgcggggcgacgatcccggcttccccgtccccgccatgccgcctgaaacgcaaataccgcccgaaggcatccctgaagcctacggcgcggataccggcccgatgacggccgtgccgccaaagagtgcgaatcacgcccaaacaggcatggaaacgccgacggtgtcggacaacctc

SEQ ID NO: 6342 - protein, 755 aa, Neisseria gonorrhoeae
LEALLMGTDVPETGVLPDKNGEPLTIGEYRLFVGEMMNQPAWRAVADKEMDYADGRQLDNELLQKQRELGLPPAVENLITPTLLSVQGYEATIRTDWRVTADGETGGRDVADALNFKLNRAERQSRADKACSDAFRGQIACGIGWVEVTRNPNPFEFPYECGVIHRNAIHWDMKSYKYDLSDARWLIRRRWLLPERLAQFFPEYAGHFKAMGRGGSDWRISGEMLDGGGNTGLADAWGISGRNTVSEEFWFNETTRELAVAEVWYRRWVTADCLRDKKTGRTVEFDGANPNHREMAANGAVLFAASVPRMRRAFVVGDLVVRDEPTPYPHQKFPYVPFFGFREDNTGIPYGYVRNMKYAQDNLNSTNSKLRWGLSAIRTVRTKGIVDMSDEQFRRNIARVDADIVLNKIEAAQPGARFDVSRDFELSAQHWQMLQDSRATIRQISGITPSFMGNRGNATSGRQESIQVEQSNQSLGLVMDNFRQSRSLVGELLLAMIIEDLGSDEQTVVIEGDAVTQGRTVVINRPETDPVTGKAYLSNDLQNIRLKVALEDVPSTNSYRSQQLGAMSEAVKSLPPEYQAAVLPFMVSLMDIPFKDKVIEKIKEVRVQETPEQIEARIAQAVQDALAKSGNDIKRRELALKEQRTASEIKEIEARAVQIGVQAAYAAMQAGGQIAAMPQIAPVADAVMQGAGYIRPARGDDPGFPVPAMPPETQIPPEGIPEAYGADTGPMTAVPPKSANHAQTGMETPTVSDNL

SEQ ID NO: 6343 - DNA, 1272 bp, Neisseria gonorrhoeae; identical to SEQ ID NO: 89

SEQ ID NO: 6344 - protein, 424 aa, Neisseria gonorrhoeae; identical to SEQ ID NO: 90

SEQ ID NO: 6345 - DNA, 240 bp, Neisseria gonorrhoeae
ttggcggaaaacctgtccaaaagcgcggagcagattgtcgcggaattgtacggaagcccggaggacacattcacaaaggcgcgtatgttccaaacggtggcggcggggtttaaggttttggtggaaatcgagcgtaaatcatacggtatggataccgccgaatcgaagatttcggaatccgccaagacggcgggcatccgtatcgaatttgtagggcctgaagatgacgggaaagacggt

SEQ ID NO: 6346 - protein, 80 aa, Neisseria gonorrhoeae
LAENLSKSAEQIVAELYGSPEDTFTKARMFQTVAAGFKVLVEIERKSYGMDTAESKISESAKTAGIRIEFVGPEDDGKDG

SEQ ID NO: 6347 - DNA, 261 bp, Neisseria gonorrhoeae
ttggcggattccgaaatcttcgattcggcggtatccataccgtatgatttacgctcgatttccaccaaaaccttaaaccccgccgccaccgtttggaacatacgcgcctttgtgaatgtgtcctccgggcttccgtacaattccgcgacaatctgctccgcgcttttggacaggttttccgccaaattccgatgcctgcgctgtacggcggcaacccgtttcgcttccgcgtccgttacttatttaaggttgaaatccgca

SEQ ID NO: 6348 - protein, 87 aa, Neisseria gonorrhoeae
LADSEIFDSAVSIPYDLRSISTKTLNPAATVWNIRAFVNVSSGLPYNSATICSALLDRFSAKFRCLRCTAATRFASASVTYLRLKSA

SEQ ID NO: 6349 - DNA, 276 bp, Neisseria gonorrhoeae
atgcctgcgctgtacggcggcaacccgtttcgcttccgcgtccgttacttatttaaggttgaaatccgcataatccggcgcattgccgtttttgtccgcggacagcaccatcgcccgcgcctttgcctgtacctcgtcattcaaatcgcgcgtccacacgcgttctttggcaaccctgccgacgtgttgcgccgaaacattgtatttgcgcccgatttcggcaatgctcaaaaccccgcgccggtaatccagctcgactttgcgccaatcctcatc

SEQ ID NO: 6350 - protein, 92 aa, Neisseria gonorrhoeae
MPALYGGNPFRFRVRYLFKVEIRIIRRIAVFVRGQHHRPRLCLYLVIQIARPHAFFGNPADVLRRNIVFAPDFGNAQNPAPVIQLDFAPILI

SEQ ID NO: 6351 - DNA, 1389 bp, Neisseria gonorrhoeae
atgcaagtatttttagacaatctcaaagcctttttcgaaaccgtcagcagctgggtttggggatctgttatgttgatgctgctggtcggcaccggcattgtgctgaccgttatgctgaaaggcttgcagttcactatgttgggctatgcgctgaaacaggcgtttgtgccgtcaaagaagtatgaaggcggcgcaggccacgaaggcgatatttcccattttgcggcgttgatgaccgcgctgtccgccaccatcggtacgggtaacatcgccggcgtggcgactgcagtggtaaccggcggcccgggcgcggtattttggatgtggatgaccgctattttcggcatggccaccaaatacggcgaaggcgtgttggcggtgaaataccgcgtcaacaattccaaaggcgaaatgtccggcggcccgatgtattacatcgaaaaaggcttgggcaaaaactggaaatggatggccgttgcatttgcgctgttcggcacattcgcttccttcggtatcggcagctcggtgcagtccaactcggttgcacaggctgtgcaaaccagcttcggtatcgaacctgcctataccggcattacgttgaccgttctgactgccgttgtcgttttaggtggtattaaaggcatcgccaaagccgcttctttcatcgtgcctgctatggcggtgttttatgtgttgggcggtctttccattatcgtcattaattccgatgcactgatgcctgccgtcaagctgattttctccgatgcgttcagcgcgcaggccgtagcaggcggcgctatcggtacggtcatccgctacggcgtggcgcgcggcgtgttctccaatgaggcgggtatgggttctgcgcctattgccgccgcagccgcgaaaaccgaccaccccgttcgtcaggctttggtttccatgaccggtacttttttggacaccattgttgtctgctcgattaccggtatcgtgttggtcatgggtctgctcggcgcaggcggcgagtttgtgaaacctgaattgagcggcgcggcgctgacaaccgtcactttccaaaaaatgctgcccggcatcggcggctggattgtgaccatcggcctgattttctttgcctactcaaccattctcggctggtgttattacggcgagaaatgcgcggtttacgtcttcggcgagaagtttgccgctttgtaccgcgtcggttatgtttcttccgtcatgccgggtaccgtgttgagccttgatttggtatggctggcttcggatacattcaacggcttgatggcattgcccaacctgactgcgcttttgttgatggcgaaagtcatcgtcaatgaaacacgcgacttcaaacaaaaaatcacaaacggcgaattgccgcat

SEQ ID NO: 6352 - protein, 463 aa, Neisseria gonorrhoeae
MQVFLDNLKAFFETVSSWVWGSVMLMLLVGTGIVLTVMLKGLQFTMLGYALKQAFVPSKKYEGGAGHEGDISHFAALMTALSATIGTGNIAGVATAVVTGGPGAVFWMWMTAIFGMATKYGEGVLAVKYRVNNSKGEMSGGPMYYIEKGLGKNWKWMAVAFALFGTFASFGIGSSVQSNSVAQAVQTSFGIEPAYTGITLTVLTAVVVLGGIKGIAKAASFIVPAMAVFYVLGGLSIIVINSDALMPAVKLIFSDAFSAQAVAGGAIGTVIRYGVARGVFSNEAGMGSAPIAAAAAKTDHPVRQALVSMTGTFLDTIVVCSITGIVLVMGLLGAGGEFVKPELSGAALTTVTFQKMLPGIGGWIVTIGLIFFAYSTILGWCYYGEKCAVYVFGEKFAALYRVGYVSSVMPGTVLSLDLVWLASDTFNGLMALPNLTALLLMAKVIVNETRDFKQKITNGELPH

SEQ ID NO: 6353 - DNA, 1584 bp, Neisseria gonorrhoeae
atggcacttttcctcagcatattccccatcgtcctgctgatttggctgatggtgaaaaaaaacagtatgccttcctacgtcgcactgccgattaccgcagtgctgatttacgccatcaaacttttctacttcggcgatgcgggaatgctgctcaacgccaccgccgcttccggcctcgtcaaaacgctcacgccgattaccgtgattttcggcgcgattatgttcaaccgtatgatggaaaccacgggctgcatcgatgtcatccgcaaatggctggcgaccatcagcccgaaccccgtagcgcaactgatgattatcggctgggcttttgcctttatgattgaaggcgcatccggcttcggcacgcctgccgcgattgccgcgccgattctgatgagcttgggcttcaatccgttgaaagtggcgattttcactttggtgatgaattccgtgccggtatcgttcggcgcggtcggtacgccgacctggttcggtttcgcaccgctgaacctgagtgccgaagacatcctcgccatcggcaggcagaccggcgtgatgcacttcttcgcaggtttcgtcatccctgtcatcggtttgggcttcatcgtgccttggtctgaaatccgcaaaaacttgggcttcgtcgccattgccgtcttctcctgcaccattccttatgccgcattggcgatggtcaacgaagaattcccgtcgctcgtcgccggcgcaatcggcctgatggtgtccgtattcgccgccaaccaaggctggggcttgagcaaagaccacgccaaagacccgaatgccgaaaaagtgccgttcgcccaagtcgccaaagcactcgcccctttgggtatgctgatcggcatgctggtggttacccgcatcaaacagctcggaatcaaaggcattttgaccagcaaagaagaatggttcagcttccaactgccgtttgatttgtccaaaattaccgtcagcgactccctgacgattaccttcggcaatattttcggacaagatgtcagcgcgtcttaccaaacgctgtacgtcccggcttggattccgttcgtgctgaccgtttggatttgcatcctgctgtataaaaccaaattcaaagatgcctggacgatttatgccgtaaccttcaatcaaaccaaaaaaccgctgcttgccctgatgggtgcgctgattatggttcagctgatgctggtcggcggcgacaattcgatggtgaaaatcatcggtaaggaatttgccgcaatggcgggcgaacactgggtttatttttcgccgtatctgggcgcgatcggtgcgttcttctccggctccaacaccgtgtccaacctgaccttcggtccgattcagcagcaaatcgcccttgataccggcctgtccgtgaccctgattctggcgttgcagtccgtcggcggcgcgatgggcaatatggtgtgcctcaacaacatcatcgccgtatgtaccgtattggacgtgaaaaattccgaaggtgcgattatcaagaaaaccgttatcccgatggcgatttacggcgtgattgccgtcgtcgcggcaatgattttcttcctc

SEQ ID NO: 6354 - protein, 528 aa, Neisseria gonorrhoeae
MALFLSIFPIVLLIWLMVKKNSMPSYVALPITAVLIYAIKLFYFGDAGMLLNATAASGLVKTLTPITVIFGAIMFNRMMETTGCIDVIRKWLATISPNPVAQLMIIGWAFAFMIEGASGFGTPAAIAAPILMSLGFNPLKVAIFTLVMNSVPVSFGAVGTPTWFGFAPLNLSAEDILAIGRQTGVMHFFAGFVIPVIGLGFIVPWSEIRKNLGFVAIAVFSCTIPYAALAMVNEEFPSLVAGAIGLMVSVFAANQGWGLSKDHAKDPNAEKVPFAQVAKALAPLGMLIGMLVVTRIKQLGIKGILTSKEEWFSFQLPFDLSKITVSDSLTITFGNIFGQDVSASYQTLYVPAWIPFVLTVWICILLYKTKFKDAWTIYAVTFNQTKKPLLALMGALIMVQLMLVGGDNSMVKIIGKEFAAMAGEHWVYFSPYLGAIGAFFSGSNTVSNLTFGPIQQQIALDTGLSVTLILALQSVGGAMGNMVCLNNIIAVCTVLDVKNSEGAIIKKTVIPMAIYGVIAVVAAMIFFL

SEQ ID NO: 6355 - DNA, 240 bp, Neisseria gonorrhoeae
atgccgagattgtcagatgaggattggcgcaaagtcgagctggattaccggcgcggggttttgagcattgccgaaatcgggcgcaaatacaatgtttcggcgcaacacgtcggcagggttgccaaagaacgcgtgtggacgcgcgatttgaatgacgaggtacaggcaaaggcgcgggcgatggtgctgtccgcggacaaaaacggcaatgcgccggattatgcggatttcaaccttaaa

SEQ ID NO: 6356 - protein, 80 aa, Neisseria gonorrhoeae
MPRLSDEDWRKVELDYRRGVLSIAEIGRKYNVSAQHVGRVAKERVWTRDLNDEVQAKARAMVLSADKNGNAPDYADFNLK

SEQ ID NO: 6357 - DNA, 420 bp, Neisseria gonorrhoeae
atgtcgggattgtcggatattgacaaggtgtaccagggggttgtggatttgcacaacgcggagcaggtggtcagccgcgaggctttggcggaaacgacaggcctgaaaatgtcggaaatcactaaatttaccaagctgctggtcgagcacggcaaaatctaccgcgtgacaagggggattttcaagcccgccatagggtttggcgagacgcgccccgtcagcgtatcggtattggattcggggatgggcgtattggaaataggcgatacggtattgcacctcaacccgcaggaaatgcgctcgttgggggctttgatgtcggggttcggacagcagttttccagtattcagatggggcgcgagttttcagtgttgcggaattatctggaatgttccgccaaaaacgggaggttggatttt

SEQ ID NO: 6358 - protein, 140 aa, Neisseria gonorrhoeae
MSGLSDIDKVYQGVVDLHNAEQVVSREALAETTGLKMSEITKFTKLLVEHGKIYRVTRGIFKPAIGFGETRPVSVSVLDSGMGVLEIGDTVLHLNPQEMRSLGALMSGFGQQFSSIQMGREFSVLRNYLECSAKNGRLDF

SEQ ID NO: 6359 - DNA, 543 bp, Neisseria gonorrhoeae; identical to SEQ ID NO: 299

SEQ ID NO: 6360 - protein, 181 aa, Neisseria gonorrhoeae; identical to SEQ ID NO: 300

SEQ ID NO: 6361 - DNA, 381 bp, Neisseria gonorrhoeae; identical to SEQ ID NO: 301

SEQ ID NO: 6362 - protein, 127 aa, Neisseria gonorrhoeae; identical to SEQ ID NO: 302

SEQ ID NO: 6363 - DNA, 417 bp, Neisseria gonorrhoeae
ttgcgcgggcggattgtgatttcaaggttgccgttttcaaaccacccgtccgggctgtcccaaatcgaccgcataacctgctttttgttttggggcgtcagtgtaaattccgccccgttcatttcagacggcctttcacgccgacaacccccaatgcttcaaggcggcgtatcgtgcgcaattgcgaacggcgcatataaaactctttgtcttcgcggcttaggcctgcgcccctgccgtcgatcgcgccgcggcggcaaccgcacccgaaacccgcgcccaaaccgccgcttttcaatcccgccccgtgcgtctcgcccgggaaacggcacaacacgaccgtttcagggttgtcattgcacacgcccgcgatgttcggcgtgcattgcccgcctttggcggctttgcgtatcgcgc

SEQ ID NO: 6364 - protein, 139 aa, Neisseria gonorrhoeae
LRGRIVISRLPFSNHPSGLSQIDRITCFLFWGVSVNSAPFISDGLSRRQPPMLQGGVSCAIANGAYKTLCLRGLGLRPCRRSRRGGNRTRNPRPNRRFSIPPRASRPGNGTTRPFQGCHCTRPRCSACIARLWRLCVSR

SEQ ID NO: 6365 - DNA, 303 bp, Neisseria gonorrhoeae
atgtctagcgcgatacgcaaagccgccaaaggcgggcaatgcacgccgaacatcgcgggcgtgtgcaatgacaaccctgaaacggtcgtgttgtgccgtttcccgggcgagacgcacggggcgggattgaaaagcggcggtttgggcgcgggtttcgggtgcggttgccgccgcggcgcgatcgacggcaggggcgcaggcctaagccgcgaagacaaagagttttatatgcgccgttcgcaattgcgcacgatacgccgccttgaagcattgggggttgtcggcgtgaaaggccgtctgaaa

SEQ ID NO: 6366 - protein, 101 aa, Neisseria gonorrhoeae
MSSAIRKAAKGGQCTPNIAGVCNDNPETVVLCRFPGETHGAGLKSGGLGAGFGCGCRRGAIDGRGAGLSREDKEFYMRRSQLRTIRRLEALGVVGVKGRLK

SEQ ID NO: 6367 - DNA, 618 bp, Neisseria gonorrhoeae
ttggcggctttgcgtatcgcgctagacatcccaaccctcctgtccgatgaaatcccaaccctcgtctgccgcatccgtctgttccatctccaattcccccacctccaccgccaaaccgccgcccgttaccggttcgccgccatattcggcggcaatgcgccgcacctgcctgtcgttgtgataggcaacgccttgaagcgcgtccagagtaaccttcagggcgttgtccaaatcgatcaccgtcttgtttgcgccgccgtctttgttcgctttgggtatcagccgcacatatacggcaaccgcgccttcggacggcatcgcgcccgccccttgcgcgatacggcggacggtttccttatacgccgccgcctccgcgctcctgaccgccctgttgcgccaaatccgccaatatcggtttgccgatacggggtaaggcaggataaggcgcgtcacgcgcattcccctgccggttgcgtccacaggccggcgcccaatatcgggcaggcggcgtgcgcggcgcggatgtatccgtgcagccttgccgccgtcatcgcgccggctcccgccgccgcgcgcttttgccggactgccttgttgcggcaggttttgcacgatttg

SEQ ID NO: 6368 - protein, 206 aa, Neisseria gonorrhoeae
LAALRIALDIPTLLSDEIPTLVCRIRLFHLQFPHLHRQTAARYRFAAIFGGNAPHLPVVVIGNALKRVQSNLQGVVQIDHRLVCAAVFVRFGYQPHIYGNRAFGRHRARPLRDTADGFLIRRRLRAPDRPVAPNPPISVCRYGVRQDKARHAHSPAGCVHRPAPNIGQAACAARMYPCSLAAVIAPAPAAARFCRTALLRQVLHDL

SEQ ID NO: 6369 - DNA, 99 bp, Neisseria gonorrhoeae
atgacggcggcaaggctgcacggatacatccgcgccgcgcacgccgcctgcccgatattgggcgccggcctgtggacgcaaccggcaggggaatgcgcg

SEQ ID NO: 6370 - protein, 33 aa, Neisseria gonorrhoeae
MTAARLHGYIRAAHAACPILGAGLWTQPAGECA

SEQ ID NO: 6371 - DNA, 630 bp, Neisseria gonorrhoeae; identical to SEQ ID NO: 303

SEQ ID NO: 6372 - protein, 210 aa, Neisseria gonorrhoeae; identical to SEQ ID NO: 304

SEQ ID NO: 6373 - DNA, 1905 bp, Neisseria gonorrhoeae; identical to SEQ ID NO: 2075

SEQ ID NO: 6374 - protein, 635 aa, Neisseria gonorrhoeae; identical to SEQ ID NO: 2076

SEQ ID NO: 6375 - DNA, 1782 bp, Neisseria gonorrhoeae
ttgtttggcggggcgggctgttccggcaccgggattctgcccgacgcgccgcccggacgagcggcggtttccgttccccgcgtgctgccgctatggatggcggcgtttcgcctagaggaagaaaatcattgccgcgacgacggcaatcacgccgtaaatcgccatcgggataacggttttcttgataatcgcaccttcggaatttttcacgtccaatacggtacatacggcgatgatgttgttgaggcacaccatattgcccatcgcgccgccgacggactgcaacgccagaatcagggtcacggacaggccggtatcaagggcgatttgctgctgaatcggaccgaaggtcaggttggacacggtgttggagccggagaagaacgcaccgatcgcgcccagatacggcgaaaaataaacccagtgttcgcccgccattgcggcaaattccttaccgatgattttcaccatcgaattgtcgccgccgaccagcatcagctgaaccataatcagcgcacccatcagggcaagcagcggttttttggtttgattgaaggttacggcataaatcgtccaggcatctttgaatttggttttatacagcaggatgcaaatccaaacggtcagcacgaacggaatccaagccgggacgtacagcgtttggtaagacgcgctgacatcttgtccgaaaatattgccgaaggtaatcgtcagggagtcgctgacggtaattttggacaaatcaaacggcagttggaagctgaaccattcttctttgctggtcaaaatgcctttgattccgagctgtttgatgcgggtaaccaccagcatgccgatcagcatacccaaaggggcgagtgctttggcgacttgggcgaacggcactttttcggcattcgggtctttggcgtggtctttgctcaagccccagccttggttggcggcgaatacggacaccatcaggccgattgcgccggcgacgagcgacgggaattcttcgttgaccatcgccaatgcggcataaggaatggtgcaggagaagacggcaatggcgacgaagcccaagtttttgcggatttcagaccaaggcacgatgaagcccaaaccgatgacagggatgacgaaacctgcgaagaagtgcatcacgccggtctgcctgccgatggcgaggatgtcttcggcactcaggttcagcggtgcgaaaccgaaccaggtcggcgtaccgaccgcgccgaacgataccggcacggaattcatcaccaaagtgaaaatcgccactttcaacggattgaagcccaagctcatcagaatcggcgcggcaatcgcggcaggcgtgccgaagccggatgcgccttcaatcataaaggcaaaagcccagccgataatcatcagttgcgctacggggttcgggctgatggtcgccagccatttgcggatgacatcgatgcagcccgtggtttccatcatacggttgaacataatcgcgccgaaaatcacggtaatcggcgtgagcgttttgacgaggccggaagcggcggtggcgttgagcagcattcccgcatcgccgaagtagaaaagtttgatggcgtaaatcagcactgcggtaatcggcagtgcgacgtaggaaggcatactgttttttttcaccatcagccaaatcagcaggacgatggggaatatgctgaggaaaagtgccataacgaatcctttttaggcatttgcatcataaggcgcgtcgaggtttggaaagacgttcaaatcccgcacacccgatattttggt

SEQ ID NO: 6376 - protein, 594 aa, Neisseria gonorrhoeae
LFGGAGCSGTGILPDAPPGRAAVSVPRVLPLWMAAFRLEEENHCRDDGNHAVNRHRDNGFLDNRTFGIFHVQYGTYGDDVVEAHHIAHRAADGLQRQNQGHGQAGIKGDLLLNRTEGQVGHGVGAGEERTDRAQIRRKINPVFARHCGKFLTDDFHHRIVAADQHQLNHNQRTHQGKQRFFGLIEGYGINRPGIFEFGFIQQDANPNGQHERNPSRDVQRLVRRADILSENIAEGNRQGVADGNFGQIKRQLEAEPFFFAGQNAFDSELFDAGNHQHADQHTQRGECFGDLGERHFFGIRVFGVVFAQAPALVGGEYGHHQADCAGDERREFFVDHRQCGIRNGAGEDGNGDEAQVFADFRPRHDEAQTDDRDDETCEEVHHAGLPADGEDVFGTQVQRCETEPGRRTDRAERYRHGIHHQSENRHFQRIEAQAHQNRRGNRGRRAEAGCAFNHKGKSPADNHQLRYGVRADGRQPFADDIDAARGFHHTVEHNRAENHGNRRERFDEAGSGGGVEQHSRIAEVEKFDGVNQHCGNRQCDVGRHTVFFHHQPNQQDDGEYAEEKCHNESFLGICIIRRVEVWKDVQIPHTRYFG

SEQ ID NO: 6377 - DNA, 243 bp, Neisseria gonorrhoeae
ttgcgcgggacggcattaaaccctttctccaacggcttggtcccgccgcaggccttgcaggtgcgcatttcttccgccattttgatttttccttttgtttttatgtgtttaatatccgaagccgtcgaagtcgtcttcgcctttgccgtcgcgcttgcggcgcaaaaccgcgtcggcggcttccaccaaaagccataccgccaacgtcgccgcgccgccgaacgacagcgcggtgatgatgct

SEQ ID NO: 6378 - protein, 81 aa, Neisseria gonorrhoeae
LRGTALNPFSNGLVPPQALQVRISSAILIFPFVFMCLISEAVEVVFAFAVALAAQNRVGGFHQKPYRQRRRAAERQRGDDA

SEQ ID NO: 6379 - DNA, 147 bp, Neisseria gonorrhoeae
atggataccctgttaagcatcatcaccgcgctgtcgttcggcggcgcggcgacgttggcggtatggcttttggtggaagccgccgacgcggttttgcgccgcaagcgcgacggcaaaggcgaagacgacttcgacggcttcggatat

SEQ ID NO: 6380 - protein, 49 aa, Neisseria gonorrhoeae
MDTLLSIITALSFGGAATLAVWLLVEAADAVLRRKRDGKGEDDFDGFGY

SEQ ID NO: 6381 - DNA, 111 bp, Neisseria gonorrhoeae
atgttggaatttcgggaaactgatgaaccgtcattcccgccgatttccgtcattcccgcgaaagcgggaatccggaaaccccgaacgcggcaggaatttatcggaaacggc

SEQ ID NO: 6382 - protein, 37 aa, Neisseria gonorrhoeae
MLEFRETDEPSFPPISVIPAKAGIRKPRTRQEFIGNG

SEQ ID NO: 6383 - DNA, 369 bp, Neisseria gonorrhoeae
gtgatgatgcttaacagggtatccattgttttatttcctttcggtcggttttatgggtcggggtcggattcccgccgcctccgtcattcccgcgcaggcgggaatccggaaaccccgaacgcggcaggaatctatcggaaacggctgaaaccggacggaccggattcccgcctgcgcgggaatgacggttcggttgctacggttactgtcaggtttcggtcatgttggaatttcgggaaactgatgaaccgtcattcccgccgatttccgtcattcccgcgaaagcgggaatccggaaaccccgaacgcggcaggaatttatcggaaacggctgaaaccggacggaccggattcccgcctgcgcgggaa

SEQ ID NO: 6384 - protein, 123 aa, Neisseria gonorrhoeae
VMMLNRVSIVLFPFGRFYGSGSDSRRLRHSRAGGNPETPNAAGIYRKRLKPDGPDSRLRGNDGSVATVTVRFRSCWNFGKLMNRHSRRFPSFPRKRESGNPERGRNLSETAETGRTGFPPARE

SEQ ID NO: 6385 - DNA, 180 bp, Neisseria gonorrhoeae
gtgattcccgacgctttcgtcattcccgcgcaggcgggaatccggtccgtccggtttcagccgtttccgataaattcctgccgcgttcggggtttccggattcccgctttcgcgggaatgacggaaatcggcgggaatgacggttcatcagtttcccgaaattccaacatgaccgaaacc

SEQ ID NO: 6386 - protein, 60 aa, Neisseria gonorrhoeae
VIPDAFVIPAQAGIRSVRFQPFPINSCRVRGFRIPAFAGMTEIGGNDGSSVSRNSNMTET

SEQ ID NO: 6387 - DNA, 477 bp, Neisseria gonorrhoeae
gtgcggggcccgccccgcttcaggcggcattttttccaacaaatcttcgacacaggcggccgcccacgcaaaattgtcttcgccgtcgcggatgtaataagcggcggagatgacggcaagcagcgcggcctccgtgccgccgtcgaacccgcaatctttcagaccggcgtacattttttcatagcggcggtgtttgagtttcttgaacttcggcgcgccggcgcgttggcgttccaagtaccgcagggctttttccaagtcttcgcgcccgcctttttccttgtgccgccagatgtatttgaaggcgttgccgaggttgaagttgaggtattgcgcaaacccgacgcactcgaaggcgcggtttttgtaatagcccgggttggtattgccgccttgttgcggcgcggcttccgtccggacggtttcggtttgcgtgtttcggactgtcattccgtatttcctttcaaatttgcgttt

SEQ ID NO: 6388 - protein, 159 aa, Neisseria gonorrhoeae
VRGPPRFRRHFFQQIFDTGGRPRKIVFAVADVISGGDDGKQRGLRAAVEPAIFQTGVHFFIAAVFEFLELRRAGALAFQVPQGFFQVFAPAFFLVPPDVFEGVAEVEVEVLRKPDALEGAVFVIARVGIAALLRRGFRPDGFGLRVSDCHSVFPFKFAF

SEQ ID NO: 6389 - DNA, 492 bp, Neisseria gonorrhoeae; identical to SEQ ID NO: 203

SEQ ID NO: 6390 - protein, 164 aa, Neisseria gonorrhoeae; identical to SEQ ID NO: 170

SEQ ID NO: 6391 - DNA, 264 bp, Neisseria gonorrhoeae; identical to SEQ ID NO: 3629

SEQ ID NO: 6392 - protein, 88 aa, Neisseria gonorrhoeae; identical to SEQ ID NO: 3630

SEQ ID NO: 6393 - DNA, 282 bp, Neisseria gonorrhoeae; identical to SEQ ID NO: 3627

SEQ ID NO: 6394 - protein, 94 aa, Neisseria gonorrhoeae; identical to SEQ ID NO: 3628

SEQ ID NO: 6395 - DNA, 1257 bp, Neisseria gonorrhoeae
atgaaagtgcttgttttaggtgcgggtgttgccggcgtatcctccgtgtggtatctggcagaggccggacatgaagtaacggtcatcgaccgcaccgagggtgtggcgatggaaaccagttttgccaatgcaggccagctttcttacggctataccacgccttgggctgcacccggtattccgaccaaagcactgaaacggctgtttaaaagccatccgcctttactgttccgccctgacggcggcctgtatcaaatcgaatggctgtggcggatgctgcaaaactgcacggcaacgcgctatcaaatcaataaagagcgcatggtcaggatttccgaatacagccgtgaaatgttccgccgttttgaagcgcaaaccgacatgaattttgagggacgcaaaaaagggacgttgcagattttccgccaaaccgaagaagtcgaagcggcaaaacaagacattgccgttttggaacgctacggcgtgccgtaccgccgtctgaagcccgaagaatgcgcagaattcgagcctgcgctggcacgcgttaccgccaaaattgtcggcggtctgcacctgcctgcggatgcgaccggcgactgccgcctcttcaccgaaaacctgtacaaattgtgtcaagagaagggcgtacggttctacttcaaccaaaccatcagccgcatcgaccacaacgggctgcgcatcaaagccgttgaaaccgaaacagggcggtttgaaacagatgccgttgtctgcgcgctcggctgcttcagcaggactgtgttggcgcagttggatctcaatctgcccatttatcccgtcaaaggctattccttgaccctgccggtcacaaattccgacggcgcaccggtgtccactgttttagatgaaagctacaaagtcgccatcacgcgttttgacaacagaatccgcgtcggcggaatggcggaattgtccggctacgaaaccaaactgcccgaaaaacgccgcgaaaccttggctttggtcgtcaacgacttgttcccggaaggcggcgatttgagccaagcattgtcctggagcggcctcaggccgatgacgcccgacagtacgccgttaatcgggcgcacccgctttgaaaacctgtttctgaataccgggcacggtactttgggctggaccatgtcgccgggttcggcaaaattgaccgccgatatcgtgagcggcaaagacaccgaaatccgcagcgacgatttgagcctgtcgcgctatcaaaaactg

SEQ ID NO: 6396 - protein, 419 aa, Neisseria gonorrhoeae
MKVLVLGAGVAGVSSVWYLAEAGHEVTVIDRTEGVAMETSFANAGQLSYGYTTPWAAPGIPTKALKRLFKSHPPLLFRPDGGLYQIEWLWRMLQNCTATRYQINKERMVRISEYSREMFRRFEAQTDMNFEGRKKGTLQIFRQTEEVEAAKQDIAVLERYGVPYRRLKPEECAEFEPALARVTAKIVGGLHLPADATGDCRLFTENLYKLCQEKGVRFYFNQTISRIDHNGLRIKAVETETGRFETDAVVCALGCFSRTVLAQLDLNLPIYPVKGYSLTLPVTNSDGAPVSTVLDESYKVAITRFDNRIRVGGMAELSGYETKLPEKRRETLALVVNDLFPEGGDLSQALSWSGLRPMTPDSTPLIGRTRFENLFLNTGHGTLGWTMSPGSAKLTADIVSGKDTEIRSDDLSLSRYQKL

SEQ ID NO: 6397 - DNA, 90 bp, Neisseria gonorrhoeae
gtgccggaacagcccgccccgccaaacaaatgccgtctgaaaccggaaaaggcttcagacggcatttttatcgccgtttgcattcaggcg

SEQ ID NO: 6398 - protein, 30 aa, Neisseria gonorrhoeae
VPEQPAPPNKCRLKPEKASDGIFIAVCIQA

SEQ ID NO: 6399 - DNA, 1359 bp, Neisseria gonorrhoeae; identical to SEQ ID NO: 205

SEQ ID NO: 6400 - protein, 453 aa, Neisseria gonorrhoeae; identical to SEQ ID NO: 206

SEQ ID NO: 6401 - DNA, 177 bp, Neisseria gonorrhoeae
atgcaatatcaacagccccgaacttcaaaatcaacattcggggggtggggaaccaacagccccgaaatgcaatatcaacagccccgaacttcaaaaccaacattcggggagtggggaatcaacagccccgaaatgcaatatcaacagccccgaacttcaaaatcaacattcggggag

SEQ ID NO: 6402 - protein, 59 aa, Neisseria gonorrhoeae
MQYQQPRTSKSTFGGWGTNSPEMQYQQPRTSKPTFGEWGINSPEMQYQQPRTSKSTFGE

SEQ ID NO: 6403 - DNA, 1131 bp, Neisseria gonorrhoeae
ttgatgatgaagccgtctgaaagtttgagagcggcaggcaggccaatcgcgtattacccgaaattggcaaagcctttgggcggtgtaaatgcggcaatattattcgggcatttcttctactggaacgataagacgcagtatgaatcaggcatttaccgaacagcggaagaaattgaaattgaaaccgggctgtccgttcaggaacaaagaacggcacgggcaaagctgagggaacgcggcgtattgattgagactgaaaaacgaattgaacaccgcatttactacaaactgaatttagacgcttttgatgatttgatgttgcaacattcggggggtggggaaccaacagccccgaaatgcaatatcaacagccccgaacttcaaaatcaacattcggggggtggggaaccaacagccccgaaatgcaatatcaacagccccgaacttcaaaaccaacattcggggagtggggaatcaacagccccgaaatgcaatatcaacagccccgaacttcaaaatcaacattcggggagtgaggaatcaacagccgttataagaacagaagatttaacagaagatttagcagtatatacccccttacccccaaacgccgaaaacggcaaaggcggtttgaacgctgacgcgtttgtttccgctgacgcggaaacgtgcgggcgggaaaccggcgaaccgacttcgccgaaggccgaaagcgacagtaacggcaacggcggcctttcgggaaaaccgaaaaatgcgaatgttccgcgccgccgcaaaacccacggcgtaccgcttcaggaaatcgccgatttgtacaacgaagttttgggcggccggttgccaagcgtccaagtgctgaacgacacgcgcaaacgggcgattgcaaaccgctggtgcgagatgctgggaacggcggcgccaaacggcaaggtgaggttcggggacaaggaaaccggtttggcctggtttgccggtttcttccggaaagtggcgatgaacccgttttggatgggcgaaaaccaaacagggtttgcggtcggcttcgattggattttcaaggcgggcaatttcgtcaaaatccttgaatggcatccgcctaaaacgaaccaggcggcaaggggaagggca

SEQ ID NO: 6404 - protein, 377 aa, Neisseria gonorrhoeae
LMMKPSESLRAAGRPIAYYPKLAKPLGGVNAAILFGHFFYWNDKTQYESGIYRTAEEIEIETGLSVQEQRTARAKLRERGVLIETEKRIEHRIYYKLNLDAFDDLMLQHSGGGEPTAPKCNINSPELQNQHSGGGEPTAPKCNINSPELQNQHSGSGESTAPKCNINSPELQNQHSGSEESTAVIRTEDLTEDLAVYTPLPPNAENGKGGLNADAFVSADAETCGRETGEPTSPKAESDSNGNGGLSGKPKNANVPRRRKTHGVPLQEIADLYNEVLGGRLPSVQVLNDTRKRAIANRWCEMLGTAAPNGKVRFGDKETGLAWFAGFFRKVAMNPFWMGENQTGFAVGFDWIFKAGNFVKILEWHPPKTNQAARGRA

SEQ ID NO: 6405 - DNA, 135 bp, Neisseria gonorrhoeae; identical to SEQ ID NO: 3619

SEQ ID NO: 6406 - protein, 45 aa, Neisseria gonorrhoeae; identical to SEQ ID NO: 3620

SEQ ID NO: 6407 - DNA, 132 bp, Neisseria gonorrhoeae; identical to SEQ ID NO: 3617

SEQ ID NO: 6408 - protein, 44 aa, Neisseria gonorrhoeae; identical to SEQ ID NO: 3618

SEQ ID NO: 6409 - DNA, 195 bp, Neisseria gonorrhoeae
ttgtttgcattgcgtttgtttttgattcataatcgcctttcgccgttacctgaaccgcttccctgcaattcagggggattacccgccccgtgcgggtttttctttatcggccgcccgtctgtccgggcggtcagccgtctttccgatttgccgtcaccccgttacaaccgggtttccacacaacggccgacggag

SEQ ID NO: 6410 - protein, 65 aa, Neisseria gonorrhoeae
LFALRLFLIHNRLSPLPEPLPCNSGGLPAPCGFFFIGRPSVRAVSRLSDLPSPRYNRVSTQRPTE

SEQ ID NO: 6411 - DNA, 186 bp, Neisseria gonorrhoeae; identical to SEQ ID NO: 3613

SEQ ID NO: 6412 - protein, 62 aa, Neisseria gonorrhoeae; identical to SEQ ID NO: 3614

SEQ ID NO: 6413 - DNA, 153 bp, Neisseria gonorrhoeae; identical to SEQ ID NO: 3611

SEQ ID NO: 6414 - protein, 51 aa, Neisseria gonorrhoeae; identical to SEQ ID NO: 3612

SEQ ID NO: 6415 - DNA, 954 bp, Neisseria gonorrhoeae
ttgctagattcccgcctgcgcgggaatgacgaatggcggtgtaaaagtaactcgaaattcaaaaaagccataccgcccggacttttgcccgatcggtatgacttttggattcaaaccgccttagcggatgtcgacatacgcgccggaatgcaggtcgcgcaacaggttgacggttgcctgtccggctttttgttggaagatgtattgccgcacggaattgcggatacgttcctccggcgtgccggcatcgcgcacttcgttcaatttgatgatgtgccagccgaattgggtgcggacaggcgcgccgacctgtccgggtttgagcgcgtggacggcttcttcaaaggcgggaaccattacgccgtcggcaaaccagcccaagtcgccgccattgcccgcgcttgcgtcttgggaatatcggcgtgccaaacctgcgaaatccgtgccgttgcgcgcctggtcgtagattttgcggatggtactttccgcgccgacggcggcgtttttgctgtcggctttaatcaggatgtgttgggcgcggtattggcgcaacggtgcgccttcgggcagggtgatgccttgtttttgcgcctgctcgaggaaggcatcaatttcagcttcgctcacgcggctgttttgcatcactgcctgctggcggactttttcggcaatgatgttgtcggcaagctcgcggcgttgggtggggctgaggtttttgagggcgggattttgtgcgacgacggcatcgatttccgcttcacttgcctgaatgttgcggcgtttgcccgcctgtacaatcagggattggttgacaagctgcatcagcacctgtcgggacagctcggattcacttatctgcgcgtcttcgggcagggtggctttggcttcggcaacggcttcggcaagccggcggttggtgatgacttcgttgtcggcaacgacggcaatgccgtc

SEQ ID NO: 6416 - protein, 318 aa, Neisseria gonorrhoeae
LLDSRLRGNDEWRCKSNSKFKKAIPPGLLPDRYDFWIQTALADVDIRAGMQVAQQVDGCLSGFLLEDVLPHGIADTFLRRAGIAHFVQFDDVPAELGADRRADLSGFERVDGFFKGGNHYAVGKPAQVAAIARACVLGISACQTCEIRAVARLVVDFADGTFRADGGVFAVGFNQDVLGAVLAQRCAFGQGDALFLRLLEEGINFSFAHAAVLHHCLLADFFGNDVVGKLAALGGAEVFEGGILCDDGIDFRFTCLNVAAFARLYNQGLVDKLHQHLSGQLGFTYLRVFGQGGFGFGNGFGKPAVGDDFVVGNDGNAV

SEQ ID NO: 6417 - DNA, 186 bp, Neisseria gonorrhoeae
atggacgaaccaagagatttagtgttgtttttgaaagaaaaaatgagcagcgcggctatcgcgaaagaggttggctgctcgaaagagtttattaataaaatcggtaacggcgagcgaaaaaacccgcgttatcaaattgttgattctttaaggagtttatacagaaagaatcaaaaccaacccaaa

SEQ ID NO: 6418 - protein, 62 aa, Neisseria gonorrhoeae
MDEPRDLVLFLKEKMSSAAIAKEVGCSKEFINKIGNGERKNPRYQIVDSLRSLYRKNQNQPK

SEQ ID NO: 6419 - DNA, 645 bp, Neisseria gonorrhoeae
ttggcaaaactggcagaagtaagtcaatcaaccatcgcagcgttggaatcgggtaggaataaaaaggctaccaatatcgcgaaacttgccaaaattttagatgtatcggctttttggcttgagacaggcgaaggcagccgaaccgcgcccgccctcatcaaccccgacctgccccacgaagtcaaagacatccaccgcccgatgatgtggagcagcaacgacccgctgcccgacgatgattatgttttcgtcccctacctcaaagagagctgcttcaaaggcggggcgggcgcgtatgaaatccccgactacaacggctaccgcctgccgttcggcaaatcaacgttaaggcgcaaaggcatcaaccccgacaacgtcttctgctgcaccctgaccggcgacagcatggaggaaaaaatcgcagaagacgcggcaatcgccgtagatacgggcgaaaccgccatacgcgacggcaaaatatacgcctttgcccaagacggcatgttccgcgtcaaatacctgatacggcagcccggcaacagcgtgctgatacgcagccacaacagcggcttctatcccgacgaaaccgcccctttggacagcctgaccgttatcggcagggtcttttggtggagcgtgttggat

SEQ ID NO: 6420 - protein, 215 aa, Neisseria gonorrhoeae
LAKLAEVSQSTIAALESGRNKKATNIAKLAKILDVSAFWLETGEGSRTAPALINPDLPHEVKDIHRPMMWSSNDPLPDDDYVFVPYLKESCFKGGAGAYEIPDYNGYRLPFGKSTLRRKGINPDNVFCCTLTGDSMEEKIAEDAAIAVDTGETAIRDGKIYAFAQDGMFRVKYLIRQPGNSVLIRSHNSGFYPDETAPLDSLTVIGRVFWWSVLD

SEQ ID NO: 6421 - DNA, 537 bp, Neisseria gonorrhoeae; identical to SEQ ID NO: 305

SEQ ID NO: 6422 - protein, 179 aa, Neisseria gonorrhoeae; identical to SEQ ID NO: 306

SEQ ID NO: 6423 - DNA, 357 bp, Neisseria gonorrhoeae
atgcaggtgctgcttggcgaagacttcaaaagagcgttgaaaaactaccccaaagaagaccgcagaaaaattgcggaatttatcgcacacgtccaacagaacggcttatcagggttacccggcaggaacaaatccagcgacaacgtaccggcagacgatcctcaatggctggaaaaagtccgatttgcccaacggcacaacctttggcactatcacatcggcattcccaaatacaacggcggcaggtatggcgatttgacatccgcctatatccttcactataccctttgcgacggctttatcaaaatcatcggttttgacagacacccgccttttatcctgcccgatattcccaaa

SEQ ID NO: 6424 - protein, 119 aa, Neisseria gonorrhoeae
MQVLLGEDFKRALKNYPKEDRRKIAEFIAHVQQNGLSGLPGRNKSSDNVPADDPQWLEKVRFAQRHNLWHYHIGIPKYNGGRYGDLTSAYILHYTLCDGFIKIIGFDRHPPFILPDIPK

SEQ ID NO: 6425 - DNA, 1878 bp, Neisseria gonorrhoeae
atgttagacaaatactcccccgccgaaatcgaatccaaacactatcaaaactgggaaagccaaggctatttccggcccgatatggatttgaccaaaccgtctttttccatccaactgccgccgcccaacgtaaccggcacgctgcacatgggtcatgccttcaaccaaaccatcatggacggcctgacccgctactaccgcatgaaaggctgcaacaccgcctggattcccggtaccgaccacgcgggcatcgccacgcaaatcgtggtcgagcgtcagcttgccgcgcaaaacgtgtcccgtcacgacttggggcgcgaaaaattcttggaaaaagtgtgggagtggaaagaagtttccggcggcacgattacccagcagatgcgccgcgtgggctgctccgccgactggacgcgcgagtatttcacgatggacggcgtacgcgccgaaaccgtgaccgaagtgttcgtgcgcctgtatgaacagggcttgatttaccgcggcaaacgcttggtgaactgggatcccgtgcttggcacggcggtgtcggatttggaagtggaaagcatggaagaacaaggctctatgtggcacatccgctatccgctggccgacaatcccaccgaagccgttatcgtggcgaccacccgtcctgaaacgttgctgggcgacgcggccgttgccgtcaatccagaagatgaacgttacacccacttaatcggcaaagaattaatcctgccgctgaccggtcgcaccattccggttatcgccgacgaatacgttgaaaaagacttcggtaccggttgcgtgaaaatcacgcctgcgcacgatttcaacgattacgaagtcggcaaacgccacgacacgcgcctgattaacgtgttcgacttagaagccaaagtgctggcaaacgccgaagtgttcaacttcaaaggcgaagcgcaaccaggcttttccctgcctgaaaaatacgcaggcttggaccgctttgccgcgcgcaaacaaatggttgccgatttgcaggagcaaggcttcttggtcgaaatcaaaccgcacacgctgatgacgccgaaaggcgaccgcacaggttcagtgattgagccgatgctgaccagccaatggtttgtcgccatgtccgccacaccgaacggcggcgagcctgacaacgaattcaaaggcttgagccttgccgacaaagccaaaaaagccgtcgacagcggcgcggtgcgctttatccctgaaaactgggtcaatacctacaaccaatggatgaacaacatccaagactggtgtatttcgcgccaactgtggtgggggcatcaaatccccgcgtggtacgacgaagcaggtaatgtttacgtcgcccgcaatcaggctgaagccgaaaaacaagccggcaaaacaggtttgacccgcgaagaagacgtattggacacatggttctcctccgcgctcgtgccgttctccacgctcggctggccgtctgaaaccgacgagctcaaagccttcctgccgtccaacgtcttggttaccggctacgaaatcatcttcttctgggtggcgcgcatgattatgatgaccacccacttcaccggcaaagtaccgtttaaagccgtgtacatccacggcatcgtgcgcgaccacgaaggcaaaaaaatgtccaaatccgaaggcaacgtcatcgaccctgtggatttgatcgatggtatcggcttggacaagctgctgatgaaacgtacgaccggcctgcgcaaacccgaaaccgcgccgaaagtggaagaagccacgaaaaaactcttccccgaaggtatccccagcatgggcgcggacgcattgcgcttcaccatggcgagctacgccagcttgggcccgttcggt

SEQ ID NO: 6426 - protein, 626 aa, Neisseria gonorrhoeae
MLDKYSPAEIESKHYQNWESQGYFRPDMDLTKPSFSIQLPPPNVTGTLHMGHAFNQTIMDGLTRYYRMKGCNTAWIPGTDHAGIATQIVVERQLAAQNVSRHDLGREKFLEKVWEWKEVSGGTITQQMRRVGCSADWTREYFTMDGVRAETVTEVFVRLYEQGLIYRGKRLVNWDPVLGTAVSDLEVESMEEQGSMWHIRYPLADNPTEAVIVATTRPETLLGDAAVAVNPEDERYTHLIGKELILPLTGRTIPVIADEYVEKDFGTGCVKITPAHDFNDYEVGKRHDTRLINVFDLEAKVLANAEVFNFKGEAQPGFSLPEKYAGLDRFAARKQMVADLQEQGFLVEIKPHTLMTPKGDRTGSVIEPMLTSQWFVAMSATPNGGEPDNEFKGLSLADKAKKAVDSGAVRFIPENWVNTYNQWMNNIQDWCISRQLWWGHQIPAWYDEAGNVYVARNQAEAEKQAGKTGLTREEDVLDTWFSSALVPFSTLGWPSETDELKAFLPSNVLVTGYEIIFFWVARMIMMTTHFTGKVPFKAVYIHGIVRDHEGKKMSKSEGNVIDPVDLIDGIGLDKLLMKRTTGLRKPETAPKVEEATKKLFPEGIPSMGADALRFTMASYASLGPFG

SEQ ID NO: 6427 - DNA, 201 bp, Neisseria gonorrhoeae
atggacaatctgaatccgcaggaaatttccgtgttgccggaaaatctgccgctgtattgctcgggaccggacaacgagcagtggaacgggcatccgagggtgtttttacctttgggcgaaggagaatcgggcagcgttgcctgcccgtattgcggcacgcgctaccgccttgacggcaagatgccgcatcattactacgcc

SEQ ID NO: 6428 - protein, 67 aa, Neisseria gonorrhoeae
MDNLNPQEISVLPENLPLYCSGPDNEQWNGHPRVFLPLGEGESGSVACPYCGTRYRLDGKMPHHYYA

SEQ ID NO: 6429 - DNA, 396 bp, Neisseria gonorrhoeae
ttgctgcttgccggcggaggcacggcattgatcgccctgctgctgctgcttttacgccttgcccaatccaaacgcgcgcgccgtaccgaagaatccgtccctgaagaagagcctgaccttgacgacgcggcagacgacggcataaaaatcacctttgccgaagtcgaaactccggcaacgcccgaacccgctccgaaaaacgatgtaaacgacacacttgccttaggtggggaatctgaagaagagttatcggcaaaacaaacgttcgatgtcgaaaccgatacgccttccaaccgcatcgacttggatttcgacagcctggcagccgcgcaaaacggcattttgtccggcgcacttacgcaggatgaagaaacccaaaaacgcgcggatgccgat

SEQ ID NO: 6430 - protein, 132 aa, Neisseria gonorrhoeae
LLLAGGGTALIALLLLLLRLAQSKRARRTEESVPEEEPDLDDAADDGIKITFAEVETPATPEPAPKNDVNDTLALGGESEEELSAKQTFDVETDTPSNRIDLDFDSLAAAQNGILSGALTQDEETQKRADAD

SEQ ID NO: 6431 - DNA, 366 bp, Neisseria gonorrhoeae
gtgccgaagacgtggagcttatccttgccgccgtggaaaaagccgggggcagccgcgtacaggctttggcaaagatttgcaggcggtatctcgaggggctgtcttaaggggggtaagacaaggttatttgggaatatcgggcaggataaaaggcgggtgtctgtcaaaaccgatgattttgataaagccgtcgcaaagggtatagtgaaggatataggcggatgtcaaatcgccatacctgccgccgttgtatttgggaatgccgatgtgatagtgccaaaggttgtgccgttgggcaaatcggactttttccagccattgaggatcgtctgccggtacgttgtcgctggatttgttcctgccggg

SEQ ID NO: 6432 - protein, 122 aa, Neisseria gonorrhoeae
VPKTWSLSLPPWKKPGAAAYRLWQRFAGGISRGCLKGGKTRLFGNIGQDKRRVSVKTDDFDKAVAKGIVKDIGGCQIAIPAAVVFGNADVIVPKVVPLGKSDFFQPLRIVCRYVVAGFVPAG

SEQ ID NO: 6433 - DNA, 216 bp, Neisseria gonorrhoeae
atggcaaattccaacagcgggcattctaaaaaattgcgcgcggcaacggcggcggcggcgacaaaggcaaaactggcaagcggcgaataccggcagttttcagtgcaggggcgtgccgaagacgtggagcttatccttgccgccgtggaaaaagccgggggcagccgcgtacaggctttggcaaagatttgcaggcggtatctcgaggggctgtct

SEQ ID NO: 6434 - protein, 72 aa, Neisseria gonorrhoeae
MANSNSGHSKKLRAATAAAATKAKLASGEYRQFSVQGRAEDVELILAAVEKAGGSRVQALAKICRRYLEGLS

SEQ ID NO: 6435 - DNA, 198 bp, Neisseria gonorrhoeae
atgaacgaattaatcagcagaataaatcggtttggcgcgagggcaaaggacgagcaaagccttttattgaaagttggtgaaatctgccgcgacgcagcagcgacatggaccactagaaaaagcgaaagcatcaatcacaccgccttcacttttacagtgaaaaaagacggcttaaaagagaaggtaatgattgttttg

SEQ ID NO: 6436 - protein, 66 aa, Neisseria gonorrhoeae
MNELISRINRFGARAKDEQSLLLKVGEICRDAAATWTTRKSESINHTAFTFTVKKDGLKEKVMIVL

SEQ ID NO: 6437 - DNA, 474 bp, Neisseria gonorrhoeae; identical to SEQ ID NO: 259

SEQ ID NO: 6438 - protein, 158 aa, Neisseria gonorrhoeae; identical to SEQ ID NO: 260

SEQ ID NO: 6439 - DNA, 273 bp, Neisseria gonorrhoeae; identical to SEQ ID NO: 3589

SEQ ID NO: 6440 - protein, 91 aa, Neisseria gonorrhoeae; identical to SEQ ID NO: 3590

SEQ ID NO: 6441 - DNA, 330 bp, Neisseria gonorrhoeae
gtgaaatattacggcacggcggcttacggcagccccgattgggggatggaaagatattacgcgcgggaggatatgcggcaggctttggacggttgggaggcggaaaaccgaatcctgcacgaatccgggttgattgagattgccaaaaaatcggcgcgggagtttgtccgcgatgcggacggcgaaccttatacgcaggaggattgggaaacgtaccttacggaagatgcttcccgtatcggtaaagataccgaagccgcgatgaactacgccatagacgagcgggaatggttcgcgctggcggagaacatcggcaggctggcaaattca

SEQ ID NO: 6442 - protein, 110 aa, Neisseria gonorrhoeae
VKYYGTAAYGSPDWGMERYYAREDMRQALDGWEAENRILHESGLIEIAKKSAREFVRDADGEPYTQEDWETYLTEDASRIGKDTEAAMNYAIDEREWFALAENIGRLANS

SEQ ID NO: 6443 - DNA, 258 bp, Neisseria gonorrhoeae
ttgcgtttaagttcgcggtattggcggcggtattggcggcggggctatgccttcggattcgccaagggaggcggaagccgtacggcaaagggaaaacccgccgatattgcggcaatgcgtatggcgttggctcaaaagcaggcgcaggttgcggaattgagcgccgagatttggctggaagagcggcatctgaatgcggaagaagaagccggttgccggcgggtgcacggcgatgcggaagtgccggagggtaaagaa

SEQ ID NO: 6444 - protein, 86 aa, Neisseria gonorrhoeae
LRLSSRYWRRYWRRGYAFGFAKGGGSRTAKGKPADIAAMRMALAQKQAQVAELSAEIWLEERHLNAEEEAGCRRVHGDAEVPEGKE

SEQ ID NO: 6445 - DNA, 309 bp, Neisseria gonorrhoeae
ttggtccgtacggctctgtttctccgccgccgttataagcggtttcgggatggaagctcattctttaccctccggcacttccgcatcgccgtgcacccgccggcaaccggcttcttcttccgcattcagatgccgctcttccagccaaatctcggcgctcaattccgcaacctgcgcctgcttttgagccaacgccatacgcattgccgcaatatcggcgggttttccctttgccgtacggcttccgcctcccttggcgaatccgaaggcatagccccgccgccaataccgccgccaataccgcgaact

SEQ ID NO: 6446 - protein, 103 aa, Neisseria gonorrhoeae
LVRTALFLRRRYKRFRDGSSFFTLRHFRIAVHPPATGFFFRIQMPLFQPNLGAQFRNLRLLLSQRHTHCRNIGGFSLCRTASASLGESEGIAPPPIPPPIPRT

SEQ ID NO: 6447 - DNA, 243 bp, Neisseria gonorrhoeae
ttgcgccgaaaatatcctttagcctgccgatggcgtaaaatgggcgcacgccaaccacgcaaaggaaaatcaaatggacaatctgaatccgcaggaaatttccgtgttgccggaaaatctgccgctgtattgctcgggaccggacaacgagcagtggaacgggcatccgagggtgtttttacctttgggcgaaggagaatcgggcagcgttgcctgcccgtattgcggcacgcgctaccgcct

SEQ ID NO: 6448 - protein, 81 aa, Neisseria gonorrhoeae
LRRKYPLACRWRKMGARQPRKGKSNGQSESAGNFRVAGKSAAVLLGTGQRAVERASEGVFTFGRRRIGQRCLPVLRHALPP

SEQ ID NO: 6449 - DNA, 999 bp, Neisseria gonorrhoeae
atgatgaaaatcaaagccctgatgattgccgccgcattgctggcagcagccgatgtccacgccgcaccgcaaaaggcaaaaaccgcgcccgccaaagcggtcaaagctgccgccacggcgcaaaaagaagccgcacccgcacaacagcagggcggtatccgcttttcagacggcattgccgtcgttgccgacaacgaagtcatcaccaaccgccggcttgccgaagccgttgccgaagccaaagccaccctgcccgaagacgcgcagataagtgaatccgagctgtcccgacaggtgctgatgcagcttgtcaaccaatccctgattgtacaggcgggcaaacgccgcaacattcaggcaagtgaagcggaaatcgatgccgtcgtcgcacaaaatcccgccctcaaaaacctcagccccacccaacgccgcgagcttgccgacaacatcattgccgaaaaagtccgccagcaggcagtgatgcaaaacagccgcgtgagcgaagctgaaattgatgccttcctcgagcaggcgcaaaaacaaggcatcaccctgcccgaaggcgcaccgttgcgccaataccgcgcccaacacatcctgattaaagccgacagcaaaaacgccgccgtcggcgcggaaagtaccatccgcaaaatctacgaccaggcgcgcaacggcacggatttcgcaggtttggcacgccgatattcccaagacgcaagcgcgggcaatggcggcgacttgggctggtttgccgacggcgtaatggttcccgcctttgaagaagccgtccacgcgctcaaacccggacaggtcggcgcgcctgtccgcacccaattcggctggcacatcatcaaattgaacgaagtgcgcgatgccggcacgccggaggaacgtatccgcaattccgtgcggcaatacatcttccaacaaaaagccggacaggcaaccgtcaacctgttgcgcgacctgcattccggcgcgtatgtcgacatccgc

SEQ ID NO: 6450 - protein, 333 aa, Neisseria gonorrhoeae
MMKIKALMIAAALLAAADVHAAPQKAKTAPAKAVKAAATAQKEAAPAQQQGGIRFSDGIAVVADNEVITNRRLAEAVAEAKATLPEDAQISESELSRQVLMQLVNQSLIVQAGKRRNIQASEAEIDAVVAQNPALKNLSPTQRRELADNIIAEKVRQQAVMQNSRVSEAEIDAFLEQAQKQGITLPEGAPLRQYRAQHILIKADSKNAAVGAESTIRKIYDQARNGTDFAGLARRYSQDASAGNGGDLGWFADGVMVPAFEEAVHALKPGQVGAPVRTQFGWHIIKLNEVRDAGTPEERIRNSVRQYIFQQKAGQATVNLLRDLHSGAYVDIR

SEQ ID NO: 6451 - DNA, 159 bp, Neisseria gonorrhoeae
atgagcttccatcccgaaaccgcttataacggcggcggagaaacagagccgtacggaccaagccccgaagaaatcaaataccggcaaagcccggaaaccgccgaaacacggcggatgaccgaaaaacaggcagaaggccacattaaaagcattatcaga

SEQ ID NO: 6452 - protein, 53 aa, Neisseria gonorrhoeae
MSFHPETAYNGGGETEPYGPSPEEIKYRQSPETAETRRMTEKQAEGHIKSIIR

SEQ ID NO: 6453 - DNA, 303 bp, Neisseria gonorrhoeae
atgccttgcgcggcggcgttatctgataatgcttttaatgtggccttctgcctgtttttcggtcatccgccgtgtttcggcggtttccgggctttgccggtatttgatttcttcggggcttggtccgtacggctctgtttctccgccgccgttataagcggtttcgggatggaagctcattctttaccctccggcacttccgcatcgccgtgcacccgccggcaaccggcttcttcttccgcattcagatgccgctcttccagccaaatctcggcgctcaattccgcaacctgcgcctgcttt

SEQ ID NO: 6454 - protein, 101 aa, Neisseria gonorrhoeae
MPCAAALSDNAFNVAFCLFFGHPPCFGGFRALPVFDFFGAWSVRLCFSAAVISGFGMEAHSLPSGTSASPCTRRQPASSSAFRCRSSSQISALNSATCACF

SEQ ID NO: 6455 - DNA, 108 bp, Neisseria gonorrhoeae
ttgctttcgtctttcacacttaaaatcaatgacattttcggtctcctgttaaaggtcgtttcgtctatcggtctcgcgctgttttatgccttgcgcggcggcgttatc

SEQ ID NO: 6456 - protein, 36 aa, Neisseria gonorrhoeae
LLSSFTLKINDIFGLLLKVVSSIGLALFYALRGGVI

SEQ ID NO: 6457 - DNA, 678 bp, Neisseria gonorrhoeae; identical to SEQ ID NO: 3569

SEQ ID NO: 6458 - protein, 226 aa, Neisseria gonorrhoeae; identical to SEQ ID NO: 3570

SEQ ID NO: 6459 - DNA, 222 bp, Neisseria gonorrhoeae; identical to SEQ ID NO: 3563

SEQ ID NO: 6460 - protein, 74 aa, Neisseria gonorrhoeae; identical to SEQ ID NO: 3564

SEQ ID NO: 6461 - DNA, 489 bp, Neisseria gonorrhoeae; identical to SEQ ID NO: 207

SEQ ID NO: 6462 - protein, 163 aa, Neisseria gonorrhoeae; identical to SEQ ID NO: 208

SEQ ID NO: 6463 - DNA, 213 bp, Neisseria gonorrhoeae; identical to SEQ ID NO: 3559

SEQ ID NO: 6464 - protein, 71 aa, Neisseria gonorrhoeae; identical to SEQ ID NO: 3560

SEQ ID NO: 6465 - DNA, 885 bp, Neisseria gonorrhoeae
ttgatgaacaccgaaaaccaagactgcggctacggcgcaaccgctgccgaaccgcgcggccattccttccccgatatgtggatcataggtcgtctgaatcagaccatcgagcaggttacgcaagcctacgaaacctaccgctttgatttggcggcggaaaccctgtacagcttcgtatggaacgattattgcgactggtatctggaactcgccaaagtacagctccaaaccggctgcgccagccgtcagcgcgccacacgccataccttattgcgcgtactcgaagccgccctgcgcctgctgcacccgattatcccgttcatcaccgaagaactgtggcaaaccgtcgcccccatgtgcgatgccaaaaccgccgacagcatcatgctcgcccgtttccccgaaaccgacggcggcgagattgttcagacggcattcgggcaaatgaccgtgttgcaggatttgatcggcgcagtccgcaacctgcgcggcgaaacgggcatccagcccaacgtgaaagccccgctgtttgtcgaaagcgcggacgacttggcggactacctcaaatacctgccgatgatgacccgcctgaccgaagcacggcaagtcgccgccctgcccgaaagcggagacgcgcccgtcgccgtctgcaacggcgcgcgcctgatgctgaaagtcgaaatcgacaaagccgccgaaaccgcccgtttgagcaaagaagccgagaagctgcaaaaagccttggacaaactcaatgccaaactctccaaacccggctacaccgaaaaagccccggcgcatctggtggaaaaagacaaagccgatttggcggaattggaagacaaaatggcgaaagtgcaaaatcagttggcgaagttgaaagac

SEQ ID NO: 6466 - protein, 295 aa, Neisseria gonorrhoeae
LMNTENQDCGYGATAAEPRGHSFPDMWIIGRLNQTIEQVTQAYETYRFDLAAETLYSFVWNDYCDWYLELAKVQLQTGCASRQRATRHTLLRVLEAALRLLHPIIPFITEELWQTVAPMCDAKTADSIMLARFPETDGGEIVQTAFGQMTVLQDLIGAVRNLRGETGIQPNVKAPLFVESADDLADYLKYLPMMTRLTEARQVAALPESGDAPVAVCNGARLMLKVEIDKAAETARLSKEAEKLQKALDKLNAKLSKPGYTEKAPAHLVEKDKADLAELEDKMAKVQNQLAKLKD

SEQ ID NO: 6467 - DNA, 135 bp, Neisseria gonorrhoeae
ttgattttcctttgcgtggttggcgtgcgcccattttacgccatcggcaggctaaaggatattttcggcgcaaagccgcaatccgctataatccccacttttcagacggcataccatgactgcgcttacccttcc

SEQ ID NO: 6468 - protein, 45 aa, Neisseria gonorrhoeae
LIFLCVVGVRPFYAIGRLKDIFGAKPQSAIIPTFQTAYHDCAYPS

SEQ ID NO: 6469 - DNA, 2403 bp, Neisseria gonorrhoeae
ttggctcgtttattttcactcaaaccactggtgctggcattgggcttctgtttcggcacgcattgcgccgccgataccgttgcggcggaagaggcggacgggcgtgtcgcagaaggcggtgcgcagggcgcgtccgaatccgcacaagcttccgatttgaccctcggttcgacctgcctgttttgcagtaacgaaagcggcagccccgagagaaccgaagccgccgtccaaggcagcggcgaagcatccgtccccgaagactatacgcgcattgttgccgacaggatggaaggacagtcgaaggttaaggtgcgcgcggaaggaagcgttatcatcgaacgggacggcgcagtcctcaataccgattgggcggattacgaccagtcgggcgacaccgttaccgtaggcgaccggttcgccctccaacaggacggtacgctgattcggggcgaaaccctgacctacaatctcgatcagcagaccggcgaagcgcacaacgtccgtatggaaaccgaacaaggcggacggcggctgcaaagcgtcagccgcaccgccgaaatgttgggcgaagggcgttacaaactgacggaaacccaattcaacacctgttccgccggagatgccggctggtatgtcaaggccgcctctgtcgaagccgatcggggaaaaggcataggcgttgccaaacacgccgccttcgtgttcggcggcgttccccttttctatacgccttgggcggacttcccgcttgacggcaaccgcaaaagcggactgctcgtcccgtccgtatctgccggttcggacggcgtttccctttccgtcccctattatttcaaccttgcccccaacttcgatgccactttcgcccccggcattatcggcgaacgcggcgcgacgtttgacggacaaatccgttacctgcgtcccgattacagcggacagaccgacctgacctggttgccgcacgataagaaaagcggcaggaacaaccgctatcaggcaaaatggcagcaccggcacgacatttccgacacgcttcaggcgggtgtcgatttcaaccaagtctccgacagcggctactaccgcgacttttacggcggcgaagaaatcgccggcaacgtcaacctcaaccgccgcgtatggctggattatggcggcagggcggcgggaggcagcctgaatgccggcctttcggttcagaaataccagacgctggcaaaccaaagcggctacaaagacgaaccttacgccatcatgccccgcctttctgccgattggcataaaaacgcaggcagggcgcaaatcggcgtgtccgcacaatttacccgcttcagccacgacggccgccaagacggcagccgactggtcgtgtatcccggtatcaaatgggatttcagcaacagctggggctacgtccgccccaaactcgggctgcacgccacttattacagcctcgacagtttcggcggcaaagcatcccgcagcgtcgggcgcgttttgcccgttgtcaatatcgacggcggcacaaccttcgaacgcaatacgcgcctgttcggcggcggagtcgtgcaaaccatcgagccgcgcctgttctacaactatattcctgccaaatctcaaaacgacctgcccaatttcgattcgtcggaaagcagcttcggctacgggcagcttttccgcgaaaacctctattacggcaacgaccgcatcaacgccgccaacagcctttccaccgccgtgcagagccgtattttggacggcgcgacgggggaggagcgtttccgcgccggtatcggtcagaaattctatttcaaggatgatgcggtgatgcttgacggcagcgtcggcaaaaatccgcgcagccgttccgactgggtggcattcgcctccggcggcataggcgggcgtttcaccctcgacagcagcatccactacaaccaaaacgacaaacgcgccgaacattacgccgtcggcgcaggctaccgccccgcccccggaaaagtgttgaacgcccgctacaaatacgggcgcaacgaaaaaatctacctgcaggcggacggttcctatttttacgacaaactcagccagctcgacctgtccgcacaatggccgctgacgcgcaacctgtctgccgtcgtccgctacaactacggttttgaagccaaaaaaccgatagaaatgcttgccggtgcagaatacaaaagcagttgcggctgctggggcgcgggcgtgtacgcccaacgctacgttaccggcgaaaacacctacaaaaacgccgtctttttttcacttcagttgaaagacctcagcagcgtcggcagaaaccccgcaggcaggatggatgtcgccgttcccggctacatccccgcccactctctttccgccggacgcaacaaacggccc

SEQ ID NO: 6470 - protein, 801 aa, Neisseria gonorrhoeae
LARLFSLKPLVLALGFCFGTHCAADTVAAEEADGRVAEGGAQGASESAQASDLTLGSTCLFCSNESGSPERTEAAVQGSGEASVPEDYTRIVADRMEGQSKVKVRAEGSVIIERDGAVLNTDWADYDQSGDTVTVGDRFALQQDGTLIRGETLTYNLDQQTGEAHNVRMETEQGGRRLQSVSRTAEMLGEGRYKLTETQFNTCSAGDAGWYVKAASVEADRGKGIGVAKHAAFVFGGVPLFYTPWADFPLDGNRKSGLLVPSVSAGSDGVSLSVPYYFNLAPNFDATFAPGIIGERGATFDGQIRYLRPDYSGQTDLTWLPHDKKSGRNNRYQAKWQHRHDISDTLQAGVDFNQVSDSGYYRDFYGGEEIAGNVNLNRRVWLDYGGRAAGGSLNAGLSVQKYQTLANQSGYKDEPYAIMPRLSADWHKNAGRAQIGVSAQFTRFSHDGRQDGSRLVVYPGIKWDFSNSWGYVRPKLGLHATYYSLDSFGGKASRSVGRVLPVVNIDGGTTFERNTRLFGGGVVQTIEPRLFYNYIPAKSQNDLPNFDSSESSFGYGQLFRENLYYGNDRINAANSLSTAVQSRILDGATGEERFRAGIGQKFYFKDDAVMLDGSVGKNPRSRSDWVAFASGGIGGRFTLDSSIHYNQNDKRAEHYAVGAGYRPAPGKVLNARYKYGRNEKIYLQADGSYFYDKLSQLDLSAQWPLTRNLSAVVRYNYGFEAKKPIEMLAGAEYKSSCGCWGAGVYAQRYVTGENTYKNAVFFSLQLKDLSSVGRNPAGRMDVAVPGYIPAHSLSAGRNKRP

SEQ ID NO: 6471 - DNA, 174 bp, Neisseria gonorrhoeae; identical to SEQ ID NO: 3557

SEQ ID NO: 6472 - protein, 58 aa, Neisseria gonorrhoeae; identical to SEQ ID NO: 3558

SEQ ID NO: 6473 - DNA, 810 bp, Neisseria gonorrhoeae; identical to SEQ ID NO: 209

SEQ ID NO: 6474 - protein, 270 aa, Neisseria gonorrhoeae; identical to SEQ ID NO: 210

SEQ ID NO: 6475 - DNA, 411 bp, Neisseria gonorrhoeae
atgaggacgcacatccgaacctgcgtgtatcacgattccggcacaaaaggctcaaacacggcatcaggcataagcggcacggctgccggcgcggcggaacaagcgtttttcagcgcggcgaagacggcaaaccgcagcgcgtcagccgcatccgcaaacgctccgccacacccggacaagccaaagaacggacgaaaacccatgacgtttcaaggacacaacaaccgtaaaaaagccggcggctacgccgaatacatcacgggcggcgaactgcgcctattgcaacaaaccgcctgccgcttcaaagccgccctcgaaacggccgcgtggaaacactacgtccgcgccatcaaagaatccgagccggtaccggatgccgaagcgcgccggaagcggaaaaaacaggcggcg

SEQ ID NO: 6476 - protein, 137 aa, Neisseria gonorrhoeae
MRTHIRTCVYHDSGTKGSNTASGISGTAAGAAEQAFFSAAKTANRSASAASANAPPHPDKPKNGRKPMTFQGHNNRKKAGGYAEYITGGELRLLQQTACRFKAALETAAWKHYVRAIKESEPVPDAEARRKRKKQAA

SEQ ID NO: 6477 - DNA, 192 bp, Neisseria gonorrhoeae
atggatagcgaatacctagacccgcagcaatgcgcagatattttatccgtaaaaaagcgtacatttttagagcggtacgcaccgcgtccggatttccccgcgcgaatatccgtatcgaagaaacgtttttggtggaaaaaagaagaagtcgaaggatggctagaccgccaaaaagaaaaacgcccgatgatg

SEQ ID NO: 6478 - protein, 64 aa, Neisseria gonorrhoeae
MDSEYLDPQQCADILSVKKRTFLERYAPRPDFPARISVSKKRFWWKKEEVEGWLDRQKEKRPMM

SEQ ID NO: 6479 - DNA, 444 bp, Neisseria gonorrhoeae
atgccaggcggacgaatagcggattttaccgctgcaaagcataagcctcaactattacgtccaaagccttgcgcaatcggacaaaatctgtataatctccacccttatgcggacgtggcgaaattggtagacgcaccagatttaggttctggcgccgagaggtgtgagagttcgagtctctccgtccgcaccaaaatttttatatctttcataatgttatatgccacttggtgcaaatgtggtgcaaatcacatcatcgggcgtttttctttttggcggtctagccatccttcgacttcttcttttttccaccaaaaacgtttcttcgatacggatattcgcgcggggaaatccggacgcggtgcgtaccgctctaaaaatgtacgcttttttacggataaaatatctgcgcattgctgcgggtctaggtattcgctatccatt

SEQ ID NO: 6480 - protein, 148 aa, Neisseria gonorrhoeae
MPGGRIADFTAAKHKPQLLRPKPCAIGQNLYNLHPYADVAKLVDAPDLGSGAERCESSSLSVRTKIFISFIMLYATWCKCGANHIIGRFSFWRSSHPSTSSFFHQKRFFDTDIRAGKSGRGAYRSKNVRFFTDKISAHCCGSRYSLSI

SEQ ID NO: 6481 - DNA, 678 bp, Neisseria gonorrhoeae
ttgggtatgcctgctgctttgattaaggattttctgctgactcagggtttgaagctgccgcttgacgaggttcgggcggcgtatctgacggcgcagacggtaatggatatggggatggcttcgattgaccgttctgttttgtggtgcaatgatgagggttggaaacttgccgattacctgccgtgcgatgatgtccgcgaagatgccctgaaacggctttttatggctttggattcggtgttttcacgctcgacaggtgtgcggagcgcggcggtttatgccttgatgccgtctgaaaacgccgccctccggctggtgtgcctgtcccaacagggcgaaggtttggaaaacatatgggagcaggatggaaatattaccgatgtttcgcttgcctgccgttcggcgcaaagcggttggatgaatgttgcctcggatgtacgccgttggttgaatttgggtgagctttcgggagaacgcaatcatgcttcggcggcgcaaatttccattcccgtttgcacggagagcggcggtgtattgggcgtggttcatgtggaatttgaatgcgcagagtgtgcggatacggcggcgcaggcggaatgggtggctcttgccttggctttgtccgaacctttgaagcaacttttgggcatcactgccgcagaaggagatgaaaatgtc

SEQ ID NO: 6482 - protein, 226 aa, Neisseria gonorrhoeae
LGMPAALIKDFLLTQGLKLPLDEVRAAYLTAQTVMDMGMASIDRSVLWCNDEGWKLADYLPCDDVREDALKRLFMALDSVFSRSTGVRSAAVYALMPSENAALRLVCLSQQGEGLENIWEQDGNITDVSLACRSAQSGWMNVASDVRRWLNLGELSGERNHASAAQISIPVCTESGGVLGVVHVEFECAECADTAAQAEWVALALALSEPLKQLLGITAAEGDENV

SEQ ID NO: 6483 - DNA, 111 bp, Neisseria gonorrhoeae; identical to SEQ ID NO: 2183

SEQ ID NO: 6484 - protein, 37 aa, Neisseria gonorrhoeae; identical to SEQ ID NO: 2184

SEQ ID NO: 6485 - DNA, 480 bp, Neisseria gonorrhoeae
gtgttctgcaagcaggggcaggtcttgttcggcggcttcgtagtatgcgccgtcccattcttcaaagtcggggaactgtttgcgcagggattcgatgtctgcgcctccgtcggcgagcgtttcgatggtttcgccgtgttgttcgtagagggctttggctttgtccaagactttcggcacggctttgattttccagcggcgcaggctgtcggcaagcgggttgcggaaaatgtattcgccgtagccggaggcgataagctgtacgaagccgccttcttcgacttggctgtcgaggtagcagaatgcggtcagcgtgtgctggtcgtcggacaggcaggagagggattcgtcgccggtttgggcggtgtgttcgaggtaggcggaaacgagggtatagagcagaacggatggttcttgttggcggatgtcttcaggaagggtaagcgcagtcatggtatgccgtctgaaaagtggggatta

SEQ ID NO: 6486 - protein, 160 aa, Neisseria gonorrhoeae
VFCKQGQVLFGGFVVCAVPFFKVGELFAQGFDVCASVGERFDGFAVLFVEGFGFVQDFRHGFDFPAAQAVGKRVAENVFAVAGGDKLYEAAFFDLAVEVAECGQRVLVVGQAGEGFVAGLGGVFEVGGNEGIEQNGWFLLADVFRKGKRSHGMPSEKWGL

SEQ ID NO: 6487 - DNA, 597 bp, Neisseria gonorrhoeae
atgaaaatgtctgaattattagaccatgtcgcttcctgccgtctgccgaccgaatggggcgtatttacgatgcacggttttgaagaggcaaacgggcaggaacacgtcgcgctgaccgtcggcaattgttcagacggcaatccggtgttgacgcgcatccactccgaatgtctgacgggcgacgcgctgttctcgagaaaatgcgactgcggaccgcaacttgaagcggcaatgagggcggtacaggcagaggggcgcggcatcatcgtctatctgcgtcaggaaggacgcggcatcgggctgattaacaaaatccgcgcctatcatctgcaagaacaaggtatggataccgttgaagccaatttggcactcgggctgcccgtcgatgcccgcgatttccgtttggcgcaatctatctacgaatatctgggcatccgctcggtcaaactgttgaccaacaaccccgaaaaaatccaaaccctgaaagatgcggggattaacgtggtcgaacgcattcccctgcacgtcggggaaaatctggaaaacgagcgttatctccaaaccaaagcagacaagctggggcatttgatgtcggaa

SEQ ID NO: 6488 - protein, 199 aa, Neisseria gonorrhoeae
MKMSELLDHVASCRLPTEWGVFTMHGFEEANGQEHVALTVGNCSDGNPVLTRIHSECLTGDALFSRKCDCGPQLEAAMRAVQAEGRGIIVYLRQEGRGIGLINKIRAYHLQEQGMDTVEANLALGLPVDARDFRLAQSIYEYLGIRSVKLLTNNPEKIQTLKDAGINVVERIPLHVGENLENERYLQTKADKLGHLMSE

SEQ ID NO: 6489 - DNA, 552 bp, Neisseria gonorrhoeae
ttgataaaacttattgctttatcaagctatggaaacctgtttcccgaaagacggcgcaggatgcccgttccctgcaactttgccttattccgacatcaaatgccccagcttgtctgctttggtttggagataacgctcgttttccagattttccccgacgtgcaggggaatgcgttcgaccacgttaatccccgcatctttcagggtttggattttttcggggttgttggtcaacagtttgaccgagcggatgcccagatattcgtagatagattgcgccaaacggaaatcgcgggcatcgacgggcagcccgagtgccaaattggcttcaacggtatccataccttgttcttgcagatgataggcgcggattttgttaatcagcccgatgccgcgtccttcctgacgcagatagacgatgatgccgcgcccctctgcctgtaccgccctcattgccgcttcaagttgcggtccgcagtcgcattttctcgagaacagcgcgtcgcccgtcagacattcggagtggatgcgcgtcaacaccggattgccgtc

SEQ ID NO: 6490 - protein, 184 aa, Neisseria gonorrhoeae
LIKLIALSSYGNLFPERRRRMPVPCNFALFRHQMPQLVCFGLEITLVFQIFPDVQGNAFDHVNPRIFQGLDFFGVVGQQFDRADAQIFVDRLRQTEIAGIDGQPECQIGFNGIHTLFLQMIGADFVNQPDAASFLTQIDDDAAPLCLYRPHCRFKLRSAVAFSREQRVARQTFGVDARQHRIAV

SEQ ID NO: 6491 - DNA, 207 bp, Neisseria gonorrhoeae
ttgatatttatgattttctctatcatcgtccctatttacaatgtggaaaaataccttcgctgctgcgtggattccgtgcttgccgaaaattttgccgattatgaaatgattttggtcgatgacggttcgccggacggctgcgggaagatttgcgacgaatatgcaggcaaatatccgcatataagggtaatcccatgcgtaacgccg

SEQ ID NO: 6492 - protein, 69 aa, Neisseria gonorrhoeae
LIFMIFSIIVPIYNVEKYLRCCVDSVLAENFADYEMILVDDGSPDGCGKICDEYAGKYPHIRVIPCVTP

SEQ ID NO: 6493 - DNA, 300 bp, Neisseria gonorrhoeae
ttgatatatccaatcctacggcgttacgcatgggattacccttatatgcggatatttgcctgcatattcgtcgcaaatcttcccgcagccgtccggcgaaccgtcatcgaccaaaatcatttcataatcggcaaaattttcggcaagcacggaatccacgcagcagcgaaggtatttttccacattgtaaatagggacgatgatagagaaaatcataaatatcaatacgttgtattaagatgtttgcgcgtatgcctcaaacccgcgctcgcaatgcgtttgcatccgcaccctgcaact

SEQ ID NO: 6494 - protein, 100 aa, Neisseria gonorrhoeae
LIYPILRRYAWDYPYMRIFACIFVANLPAAVRRTVIDQNHFIIGKIFGKHGIHAAAKVFFHIVNRDDDRENHKYQYVVLRCLRVCLKPALAMRLHPHPAT

SEQ ID NO: 6495 - DNA, 942 bp, Neisseria gonorrhoeae
ttggatatatcaaagctgacatttgacgcatccgccatggtcggcaaaacggagcattcggcaaagtttgacaacgattcaaaaggtttagatcagttttcggaccggttgaaaagcttgggatatcagaatctgcatatctgcatggaggcaaccggcagttattatgaagaagttgccgactacttcgcgcagtattacagcgtttacgtagtgaacccgctgaaaataagcaagtatgcagaaagcaggttcaagcgaaccaaaacagacaaacaggatgcaaagctgatagcgcagtattgccggtcggcgaaagaaagcgagcttgtaaagaggcagaagcctacggacgagcaatacaggctttcacggatgaccgcagcatacgcgcaaatcaaaagcgaatgcgcggcaatgaaaaaccgtcatcacgcggcaaaagatgaagaagcggccaaagcatatgcgcaaatcatcaaagccatgaatgaacagcttgaagttttaaaggagaagataaaagagcagacggagaagcctaactgcaaggaaggcgtgaagcgtcttgaaaccataccggcaataggcagaatgaccgcagccgtattgtttcatcatctaacatcttcgaaatttgaaacatcaaacaaatttgcagcgttcgcaggcttaagcccgcaacaaaaagaatccgggacaagcgtaaggggaaaaggcaaactgaccaagtttggcaacaggaaattacgcgccgtcttgtttatgccggccatggtcgcataccggataagggcatttcccgacttcatcaaaaggctggaagaaaagaagaagcctaaaaaagtcatcatcgcagcattgatgcgtaaactcgccgttattgcgtatcacgtacataagaaaggcggagattacgatccatcgcgttacaaatcggcg

SEQ ID NO: 6496 - protein, 314 aa, Neisseria gonorrhoeae
LDISKLTFDASAMVGKTEHSAKFDNDSKGLDQFSDRLKSLGYQNLHICMEATGSYYEEVADYFAQYYSVYVVNPLKISKYAESRFKRTKTDKQDAKLIAQYCRSAKESELVKRQKPTDEQYRLSRMTAAYAQIKSECAAMKNRHHAAKDEEAAKAYAQIIKAMNEQLEVLKEKIKEQTEKPNCKEGVKRLETIPAIGRMTAAVLFHHLTSSKFETSNKFAAFAGLSPQQKESGTSVRGKGKLTKFGNRKLRAVLFMPAMVAYRIRAFPDFIKRLEEKKKPKKVIIAALMRKLAVIAYHVHKKGGDYDPSRYKSA

SEQ ID NO: 6497 - DNA, 192 bp, Neisseria gonorrhoeae
ttgccgcaccgacaaaaatgccgtctgaaaccgctaatgggcttcagacggcatcgtcctccaccgtcattcccgcgcaggcgggaatccagaacgtcgggcaacggcaatattcaaaagccgtctgaaaatttaaaagttctagattcccgttttcacgggaatgacgaaaagttgcggacagcagaggaa

SEQ ID NO: 6498 - protein, 64 aa, Neisseria gonorrhoeae
LPHRQKCRLKPLMGFRRHRPPPSFPRRRESRTSGNGNIQKPSENLKVLDSRFHGNDEKLRTAEE

SEQ ID NO: 6499 - DNA, 129 bp, Neisseria gonorrhoeae
ttgattgccgcaccgacaaaaatgccgtctgaaaccgctaatgggcttcagacggcatcgtcctccaccgtcattcccgcgcaggcgggaatccagaacgtcgggcaacggcaatattcaaaagccgtc

SEQ ID NO: 6500 - protein, 43 aa, Neisseria gonorrhoeae
LIAAPTKMPSETANGLQTASSSTVIPAQAGIQNVGQRQYSKAV

SEQ ID NO: 6501 - DNA, 495 bp, Neisseria gonorrhoeae
atgactgcgcttacccttcctgaagacatccgccaacaagaaccatccgttctgctctataccctcgtttccgcctacctcgaacacaccgcccaaaccggcgacgaatccctctcctgcctgtccgacgaccagcacacgctgaccgcattctgctacctcgacagccaagtcgaagaaggcggcttcgtacagcttatcgcctccggctacggcgaatacattttccgcaacccgcttgccgacagcctgcgccgctggaaaatcaaagccgtgccgaaagtcttggacaaagccaaagccctctacgaacaacacggcgaaaccatcgaaacgctcgccgacggaggcgcagacatcgaatccctgcgcaaacagttccccgactttgaagaatgggacggcgcatactacgaagccgccgaacaagacctgcccctgcttgcagaacacatcctgtcaaaccgggcggcattcgcccatatcgggcaggcg

SEQ ID NO: 6502 - protein, 165 aa, Neisseria gonorrhoeae
MTALTLPEDIRQQEPSVLLYTLVSAYLEHTAQTGDESLSCLSDDQHTLTAFCYLDSQVEEGGFVQLIASGYGEYIFRNPLADSLRRWKIKAVPKVLDKAKALYEQHGETIETLADGGADIESLRKQFPDFEEWDGAYYEAAEQDLPLLAEHILSNRAAFAHIGQA

SEQ ID NO: 6503 - DNA, 1002 bp, Neisseria gonorrhoeae; identical to SEQ ID NO: 2203

SEQ ID NO: 6504 - protein, 334 aa, Neisseria gonorrhoeae; identical to SEQ ID NO: 2204

SEQ ID NO: 6505 - DNA, 435 bp, Neisseria gonorrhoeae
atggacacacccgtttacctctacacggacggcgcgtgcaaaggcaatcccggcgcgggcggctggggcgtattaatgcgctacggcagccgcgaaaaagaacttttcggcggcgaagcgcaaaccaccaacaaccgcatggagctgaccgccgttatcgaagggctgaaatcgctcaaacgccgctgcaccgtcatcatctgcaccgactcgcaatacgtcaaaaacggcatggaaaactggatacacggttggaagcgcaacggctggaaaaccgccgccaaacagcccgtcaaaaacgacgacttgtggcaagaactcgacgctctggtcgggcagcatcaagtcagctggacttgggttaaaggacacgcgggacacgcggaaaacgaacgcgccgacgatttggcaaaccgtggcgcggcacagttttct

SEQ ID NO: 6506 - protein, 145 aa, Neisseria gonorrhoeae
MDTPVYLYTDGACKGNPGAGGWGVLMRYGSREKELFGGEAQTTNNRMELTAVIEGLKSLKRRCTVIICTDSQYVKNGMENWIHGWKRNGWKTAAKQPVKNDDLWQELDALVGQHQVSWTWVKGHAGHAENERADDLANRGAAQFS

SEQ ID NO: 6507 - DNA, 873 bp, Neisseria gonorrhoeae
ttgaatatgaaggagcggatagtgggtcaaagtggcgagttgttttgtttcggacaaatgcctgtatggaaagtggaaaacctgccggaagttttattgtcgggttattcgtccgaggaaggggaatgggtctgcctgaatgtgttgcagggcgatgtcgaagtccgtgcaccggacggggcggcagaggtttggtcggcggaaagcggcgattgcgtgtttgcgccgcagcaggtgttttcggtcaaaccgaaaacggacgatgccgaaatccgtttgtcgctgtattgcgcggcggcagactattttcacaaaaaatacgggatgagtgccacgcattctgcggtcgcggcggcacaggataccgtaccggcgggcagggcgttggatatgggctgcggacaggggcgcaacgcgctgttcctgggtttgaaggggtttgatgtaaccgctgccgattgcaatcccgccgcgttggcaaacgtggcggaactggcagaggcggagggtttgaacgtccgcacgctggaatatgatttgaacgccgccgcccttcagggcgagtttgattatattgtggcaacggtggtgctgatgttcctgatgccgcagcgcgtgcccgacgtgattgccgatatgcaggcgcatacggcggcgggcgggtacaacttaatcgtatcggcaatggatacggcggatttcccctgcccgatgccgttccccttcaaatttaaagagggcgagctgaaggattattatcgggattgggagctggtcgaatataaagaagaattgggcgcgatgcacgccaaagacgaaaacggcaacccgatacggtttaaatttgtaactatgctggcgaaaaaaccagga

SEQ ID NO: 6508 - protein, 291 aa, Neisseria gonorrhoeae
LNMKERIVGQSGELFCFGQMPVWKVENLPEVLLSGYSSEEGEWVCLNVLQGDVEVRAPDGAAEVWSAESGDCVFAPQQVFSVKPKTDDAEIRLSLYCAAADYFHKKYGMSATHSAVAAAQDTVPAGRALDMGCGQGRNALFLGLKGFDVTAADCNPAALANVAELAEAEGLNVRTLEYDLNAAALQGEFDYIVATVVLMFLMPQRVPDVIADMQAHTAAGGYNLIVSAMDTADFPCPMPFPFKFKEGELKDYYRDWELVEYKEELGAMHAKDENGNPIRFKFVTMLAKKPG

SEQ ID NO: 6509 - DNA, 150 bp, Neisseria gonorrhoeae
atgccgtctgaaaaccgcagcgcggggtttgtggtgcattattatgtcgtattgcaggacaaggcacagggcaaggcggcggggtgcatcgtagcaactgataatgaaaaaagagggcgatgccgtctgaaccgcgtgttgcggcgagta

SEQ ID NO: 6510 - protein, 50 aa, Neisseria gonorrhoeae
MPSENRSAGFVVHYYVVLQDKAQGKAAGCIVATDNEKRGRCRLNRVLRRV

SEQ ID NO: 6511 - DNA, 189 bp, Neisseria gonorrhoeae
atgaagcgtgccggtttatactcgccgcaacacgcggttcagacggcatcgccctcttttttcattatcagttgctacgatgcaccccgccgccttgccctgtgccttgtcctgcaatacgacataataatgcaccacaaaccccgcgctgcggttttcagacggcattgcctgcttttttacaggcag

SEQ ID NO: 6512 - protein, 63 aa, Neisseria gonorrhoeae
MKRAGLYSPQHAVQTASPSFFIISCYDAPRRLALCLVLQYDIIMHHKPRAAVFRRHCLLFYRQ

SEQ ID NO: 6513 - DNA, 1038 bp, Neisseria gonorrhoeae
atgacgaatgaagcgtgccggtttatactcgccgcaacacgcggttcagacggcatcgccctcttttttcattatcagttgctacgatgcaccccgccgccttgccctgtgccttgtcctgcaatacgacataataatgcaccacaaaccccgcgctgcggttttcagacggcattgcctgcttttttacaggcagtagccctttttatcggacgcaatattaaggaggaacaaatgaaaggctcttttgtgcagacgcttgccatcgccggttcggattcgggcggcggtgcgggcattcaggcggatttgaaaacgtttcagatgcgcggcgtgttcggaacgtgtgtcatcaccgccgttaccgcgcaaaataccttgggcgtgtcggcggttcatctcgtcccgaccgaaaccatcaccgcacaaatccaagcaatcagggaagactttgacatccgcgcctacaaaatcggtatgctcggcacggcggaaatcatcgaatgcgttgccgacaagctgaaacactgcagctttggcaggcgcgtactcgaccctgtgatgattgccaaaggcggtgcgccgctgttgcaggattccgccgttgcggcactgacgcgcctgctgctgccggacacggacatcctgacccccaacctgcccgaggcggaagccttgacgggcgtgcatatcgaaaaccgtaaagatgcggaacgtgcggcaaaaatcctgcttgattacggtgtcaaaaatgtcattatcaaaggcggacatttgaacggcagcacaagcggacgctgcacggattggctgtttacgcaaaacgaaacgctggaattggacagcccgcgctttccgactgcccacacgcacggcacgggctgcacgttttccgcctgcattaccgccgagttggcaaaaggcttagacgtttgcaaagccgtacagactgccaaggcctacatcacggcggcaatctcaaaccctttggaaatcggcgcgggacacgggccggtcaatcattgggcgtatcgggac

SEQ ID NO: 6514 - protein, 346 aa, Neisseria gonorrhoeae
MTNEACRFILAATRGSDGIALFFHYQLLRCTPPPCPVPCPAIRHNNAPQTPRCGFQTALPAFLQAVALFIGRNIKEEQMKGSFVQTLAIAGSDSGGGAGIQADLKTFQMRGVFGTCVITAVTAQNTLGVSAVHLVPTETITAQIQAIREDFDIRAYKIGMLGTAEIIECVADKLKHCSFGRRVLDPVMIAKGGAPLLQDSAVAALTRLLLPDTDILTPNLPEAEALTGVHIENRKDAERAAKILLDYGVKNVIIKGGHLNGSTSGRCTDWLFTQNETLELDSPRFPTAHTHGTGCTFSACITAELAKGLDVCKAVQTAKAYITAAISNPLEIGAGHGPVNHWAYRD

SEQ ID NO: 6515 - DNA, 1266 bp, Neisseria gonorrhoeae; identical to SEQ ID NO: 211

SEQ ID NO: 6516 - protein, 422 aa, Neisseria gonorrhoeae; identical to SEQ ID NO: 212

SEQ ID NO: 6517 - DNA, 651 bp, Neisseria gonorrhoeae
atgaagataacacactgcaaattaaagaaagaagtacaaaaagaaccgctccgttcttttgtaccggaagttaccgcccgttctgccgccgatattttgggtatccatcccgattcggcggcactgttttaccgtaaaatccgcacggttaccaaccatcgtttggccttggctgccgatgaggttttcgagcgccccgccgggccgggcggaagctgtttcggcgggcggcgtaaaggcagacgcggtcgcggcgcggcaggaaaagcggttgtcttcggcattccgaaacgcaacgggcgggcctataccgttgccgcggacaatgccgagcctgaaacgttgccccctgccgtcaaaaagaaaatcatgccggacggtattgtttatgccgatagcccgggcagccgcggcaagtcggacgcgggcggttttacccgttgccgcatcaaccgttccaaggaatttgcagaccgtcggaaccacattaacggcattgggaacttttggaatcaggcaaaacgcgccttgcgaaaatacaacggaatcgaccgcaaacctttcccgccgttcttgaaaggatgggaatttcgacttaacttcggcacaccgccccggcagctaaaaatcctgcgggatcggtgtggaatt

SEQ ID NO: 6518 - protein, 217 aa, Neisseria gonorrhoeae
MKITHCKLKKEVQKEPLRSFVPEVTARSAADILGIHPDSAALFYRKIRTVTNHRLALAADEVFERPAGPGGSCFGGRRKGRRGRGAAGKAVVFGIPKRNGRAYTVAADNAEPETLPPAVKKKIMPDGIVYADSPGSRGKSDAGGFTRCRINRSKEFADRRNHINGIGNFWNQAKRALRKYNGIDRKPFPPFLKGWEFRLNFGTPPRQLKILRDRCGI

SEQ ID NO: 6519 - DNA, 462 bp, Neisseria gonorrhoeae; identical to SEQ ID NO: 157

SEQ ID NO: 6520 - protein, 154 aa, Neisseria gonorrhoeae; identical to SEQ ID NO: 158

SEQ ID NO: 6521 - DNA, 852 bp, Neisseria gonorrhoeae; identical to SEQ ID NO: 93

SEQ ID NO: 6522 - protein, 284 aa, Neisseria gonorrhoeae; identical to SEQ ID NO: 94

SEQ ID NO: 6523 - DNA, 471 bp, Neisseria gonorrhoeae
ttggtcgccaacatcgcccgatataagggcagctacgggctgaccaattacgccggcaaacgggtcgaatcggacgaggcgcgcctgaatgcctatatgctttccgccgaagccggtaggcggatggaaaaacaagacggcggcaaaaacctatcggtggcagccggaagtgcagttgtcttactggtttacgcgcggctacggctttccgctgtcaaacgggctgtctgccgagacggacaacttccgcagcctgatggggcggttcggctttcgggcgggcgtggacggtttggacggcggcaggctgaacatctacggcaagctgatgtacaaacgcgagtttatcggcacgatccgccacaggttcaacggctctgccgtggaggaattcaaacaccggggcggctggttggaatacggcttgggcgtggtgcgccgcaatgccggaaacggacggcagctttattt

SEQ ID NO: 6524 - protein, 157 aa, Neisseria gonorrhoeae
LVANIARYKGSYGLTNYAGKRVESDEARLNAYMLSAEAGRRMEKQDGGKNLSVAAGSAVVLLVYARLRLSAVKRAVCRDGQLPQPDGAVRLSGGRGRFGRRQAEHLRQADVQTRVYRHDPPQVQRLCRGGIQTPGRLVGIRLGRGAPQCRKRTAALF

SEQ ID NO: 6525 - DNA, 456 bp, Neisseria gonorrhoeae
atgcctatatgctttccgccgaagccggtaggcggatggaaaaacaagacggcggcaaaaacctatcggtggcagccggaagtgcagttgtcttactggtttacgcgcggctacggctttccgctgtcaaacgggctgtctgccgagacggacaacttccgcagcctgatggggcggttcggctttcgggcgggcgtggacggtttggacggcggcaggctgaacatctacggcaagctgatgtacaaacgcgagtttatcggcacgatccgccacaggttcaacggctctgccgtggaggaattcaaacaccggggcggctggttggaatacggcttgggcgtggtgcgccgcaatgccggaaacggacggcagctttattttgaggcgcaaaggtcttcgatgcacacgatgcgccagaattggcaggtcaatatgggcgtgcgcagtatgttc

SEQ ID NO: 6526 - protein, 152 aa, Neisseria gonorrhoeae
MPICFPPKPVGGWKNKTAAKTYRWQPEVQLSYWFTRGYGFPLSNGLSAETDNFRSLMGRFGFRAGVDGLDGGRLNIYGKLMYKREFIGTIRHRFNGSAVEEFKHRGGWLEYGLGVVRRNAGNGRQLYFEAQRSSMHTMRQNWQVNMGVRSMF

SEQ ID NO: 6527 - DNA, 135 bp, Neisseria gonorrhoeae
ttgccgctttccaatggtctagattcccgcctgcacgggaatgacgatttggaaattacccgaaacccaaaaacaactgaaaccgaacaggccggattcccgctacgcgggaatgacgggggggcggatgccgtc

SEQ ID NO: 6528 - protein, 45 aa, Neisseria gonorrhoeae
LPLSNGLDSRLHGNDDLEITRNPKTTETEQAGFPLRGNDGGADAV

SEQ ID NO: 6529 - DNA, 285 bp, Neisseria gonorrhoeae
gtgggcttcagcccaccgcttcagacggcatccgcccccccgtcattcccgcgtagcgggaatccggcctgttcggtttcagttgtttttgggtttcgggtaatttccaaatcgtcattcccgtgcaggcgggaatctagaccattggaaagcggcaatattcaaaggttagctgaagctttagagattctagattcccgttttcacgggaatgacgaaaggttgcgggaatccaaaccattgagcaacagcaatattcaaagattatctgaaagtttgaggttc

SEQ ID NO: 6530 - protein, 95 aa, Neisseria gonorrhoeae
VGFSPPLQTASAPPSFPRSGNPACSVSVVFGFRVISKSSFPCRRESRPLESGNIQRLAEALEILDSRFHGNDERLRESKPLSNSNIQRLSESLRF

SEQ ID NO: 6531 - DNA, 111 bp, Neisseria gonorrhoeae
atgggtcgccgggtgatgaaatggtggattgtaccgcaaccggcggcggaaatgccgtctgaaggcagattttgcgttcagacggcattgcgcttcaagactcgacgggga

SEQ ID NO: 6532 - protein, 37 aa, Neisseria gonorrhoeae
MGRRVMKWWIVPQPAAEMPSEGRFCVQTALRFKTRRG

SEQ ID NO: 6533 - DNA, 291 bp, Neisseria gonorrhoeae
gtgaggcatgtacgaaagtggagtgaaaagcaactgtattttccaccccgtcgggcaaaaataccaaaactcaaatcaagccgtccgaataccgttttcggcggtatcgtttgcggcaaaataatcacgcatccgggcattcgatatcgtcggcagtttgcgcatacatgccgtaacggcaaccttatacggcttacccttgtatggcggattaacaaaaatcaggacaaggcggcgggccgcaggcagtacgaatggtacggaaccggttcgcctggtgcttgggcgcct

SEQ ID NO: 6534 - protein, 97 aa, Neisseria gonorrhoeae
VRHVRKWSEKQLYFPPRRAKIPKLKSSRPNTVFGGIVCGKIITHPGIRYRRQFAHTCRNGNLIRLTLVWRINKNQDKAAGRRQYEWYGTGSPGAWAP

SEQ ID NO: 6535 - DNA, 1269 bp, Neisseria gonorrhoeae
ttgcgtctgtttccagcccgtgtaaaacagcgtaaaatcggcaaacccgaattatcttccgtccccatcaaggagcaagctatgttcttcaagcacatcgaagccgcccccgccgatccgattctcggtttgggcgaagcgttcaaagccgaaacccgccccgaaaaagtcaacctcggcatcggcgtgtacaaagacgcatccggcgcgacacccattgtcaaagccgtcaaagaggctgaaaaacgcctgttggaaagcgaaaccaccaaaaattacctgaccatcgacggcgttgccgactacaacgagcaaacccaaatcctgctgttcggcaaagaccacgaaatcatcgccagccgccgcgccaaaacagcgcaaagccttggcggtacaggcgcattgcgtattgcggccgaatttgccaaacgtcagttgaacgcgcaaaccatctggatttccaatccgacctggccaaaccacaacgccattgccaaagcggtcggtatccaagacaaaccttatcgctactatgatgccgccaaacactgcttggattgggacggcatgattgaagatttgaaccaagcgcaaaaaggcgacatcgtcctgctgcacggctgctgccacaaccctaccggtatcgaccctacgcccgaacaatgggaaactttagcaaaactttctgccgaaaaaggctggttgccattgtttgactttgcctaccaaggcttcggcaatggtttggaagaagatgcctatggcttgcgcgtgttcttgaaacacaatacagaattgctgattgccagctcttattccaaaaacttcggcatgtacaacgagcgtgtcggtgcattcactttggtggccgaagatgaagaaacagcagcccgcgcccacagccaaatcaaaaccatcatccgtaccttgtattccaacccggcttcacatggtgcgaacaccattgcactggtgttgaaaaatgatgatttgaaagcacaatggattgccgaacttgacgaaatgcgcggccgcatcaaagccatgcgccaaaaatttgtcgagttgctcaaggccaaaggttcaacccaagactttgattttattattgaacaaaacggtatgttctctttcagcggcttgactcccgaacaagttgaccgtttgaaaaacgagtttgccatttatgccgtccgttccggccgcatcaacgtcgccggcattaccgacgacaacatcgattatctgtgtgaaagcatcgtgaaagta

SEQ ID NO: 6536 - protein, 423 aa, Neisseria gonorrhoeae
LRLFPARVKQRKIGKPELSSVPIKEQAMFFKHIEAAPADPILGLGEAFKAETRPEKVNLGIGVYKDASGATPIVKAVKEAEKRLLESETTKNYLTIDGVADYNEQTQILLFGKDHEIIASRRAKTAQSLGGTGALRIAAEFAKRQLNAQTIWISNPTWPNHNAIAKAVGIQDKPYRYYDAAKHCLDWDGMIEDLNQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEETAARAHSQIKTIIRTLYSNPASHGANTIALVLKNDDLKAQWIAELDEMRGRIKAMRQKFVELLKAKGSTQDFDFIIEQNGMFSFSGLTPEQVDRLKNEFAIYAVRSGRINVAGITDDNIDYLCESIVKV

SEQ ID NO: 6537 - DNA, 702 bp, Neisseria gonorrhoeae
atgaaatccagacacctcgccctcgccctcggcgttgccgccctgttcgcccttgccgcgtgcgacagcaaagtccaaaccagcgtccccgccgacagcgcgcctgccgcttcggcagccgccgccccggcaggactggtcgaagggcaaaactacaccgtccttgccaacccgattccccaacagcaggcaggcaaggttgaagtgcttgagtttttcggctatttttgtccgcactgcgcccgcctcgaacctgttttgagcaaacacgccaagtcttttaaagacgatatgtacctgcgtaccgaacacgtcgtctggcagaaagaaatgctgccgctggcacgcctcgccgccgccgtcgatatggctgccgccgaaagcaaagatgtggcgaacagccatattttcgatgcgatggtcaaccaaaaaatcaagctgcaagagccggaagtcctcaaaaaatggctgggcgaacaaaccgcctttgacggcaaaaaagtccttgccgcctacgaatcccccgaaagtcaggcgcgcgccggcaaaatgcaggagctgaccgaaaccttccaaatcgacggtacgcccacggttatcgtcggcggcaaatataaagtcgaatttgccgactgggagtccggtatgaacaccatcgaccttttggcggacaaagtacgtgaagaacaaaaagccgcgcag

SEQ ID NO: 6538 - protein, 234 aa, Neisseria gonorrhoeae
MKSRHLALALGVAALFALAACDSKVQTSVPADSAPAASAAAAPAGLVEGQNYTVLANPIPQQQAGKVEVLEFFGYFCPHCARLEPVLSKHAKSFKDDMYLRTEHVVWQKEMLPLARLAAAVDMAAAESKDVANSHIFDAMVNQKIKLQEPEVLKKWLGEQTAFDGKKVLAAYESPESQARAGKMQELTETFQIDGTPTVIVGGKYKVEFADWESGMNTIDLLADKVREEQKAAQ

SEQ ID NO: 6539 - DNA, 1410 bp, Neisseria gonorrhoeae
gtgaaaatcctcattttaggcaacgggcaggtaggttctaccgtcgcgcaaaaccttgccgccatcaccaacaacgacgtaaccgttatcgacatcgacgaaaaagcattgcaggaaacaggcagccgcctcgatgtccaaaccgttttcggcaacggcgcatcccccttcacattagaacgcgccggcgcggaagatgccgacttgctgctcgcgctctcccgcagcgacgaaaccaacatcgtcgcctgcaaagttgccgccgacctgttcaacatccccggccgcatcgcgcgcgtccgttccagcgaatacctcgaatacctcagccccaagctcgaaaacaacgaaaacggcagcctttccatattcggcataaccgaaaccatcagccccgaacagctcgttaccgaacagcttgccggcctgatagactgcccgggcgcattgcaggttttacgttttgcagacgaccgcgtgcggatggtcatcatacaggcgcggcgcggcgggctgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctgtttgccgccgccgccgaaaacatcggggcggtcatacccgaattgcgccccaaagaaaccagcacccgccgcatcatgattgccggcggcggcaacatcggctaccgcctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcgcacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggtgaccacatcatctttttcgtctcgcgccggcgcatcctgaacgaactggagaaactcatccaagtcaaaatgggctttttcgga

SEQ ID NO: 6540 - protein, 470 aa, Neisseria gonorrhoeae
VKILILGNGQVGSTVAQNLAAITNNDVTVIDIDEKALQETGSRLDVQTVFGNGASPFTLERAGAEDADLLLALSRSDETNIVACKVAADLFNIPGRIARVRSSEYLEYLSPKLENNENGSLSIFGITETISPEQLVTEQLAGLIDCPGALQVLRFADDRVRMVIIQARRGGLLVGRSIADIAQDLPDGADCQICAVYRNNRLIVPAPQTVIIEGDEILFAAAAENIGAVIPELRPKETSTRRIMIAGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 6541 - DNA, 537 bp, Neisseria gonorrhoeae
gtggcaagctggaaaaccggcgacgtattgctgttgaacggcaaaatcctcaccggccgcgatgccgcgcacaaacgcctcgtcaatatgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtct

SEQ ID NO: 6542 - protein, 179 aa, Neisseria gonorrhoeae
VASWKTGDVLLLNGKILTGRDAAHKRLVNMLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 6543 - DNA, 588 bp, Neisseria gonorrhoeae
gtggatggattcgcctttgctgtccacggcgacggttacgggcatatctttgacttcaaattcgtaaacggcttccatacccaattcggggaacgccaagactttggaagatttgatggcttttgccacgaggtatgccgcgccgccgactgccatgaggtacacggccttgttgtcggcgatggcttcgcaggtggccgcgccgcgctcggatttgccgatcatgcccaagaggccggtttgtttgagcatttggcgggtaaatttgtccatgcgggtggctgtggtcggacctgcgggaccgacgacttcatcgccgaccggatcgacggggccgacgtagtaaatcaggcggttggtgaaatcgacgggcaactcctcgcctttgtcgagcatattgacgaggcgtttgtgcgcggcatcgcggccggtgaggattttgccgttcaacagcaatacgtcgccggttttccagcttgccacttcttctttggtcagcttatcgacatcgacgcgtttgccgttgtcggggctgtaagtcagatcgggtcagtcttcgacgcgcggcggcgtgagttcgacaggacc

SEQ ID NO: 6544 - protein, 196 aa, Neisseria gonorrhoeae
VDGFAFAVHGDGYGHIFDFKFVNGFHTQFGERQDFGRFDGFCHEVCRAADCHEVHGLVVGDGFAGGRAALGFADHAQEAGLFEHLAGKFVHAGGCGRTCGTDDFIADRIDGADVVNQAVGEIDGQLLAFVEHIDEAFVRGIAAGEDFAVQQQYVAGFPACHFFFGQLIDIDAFAVVGAVSQIGSVFDARRREFDRT

SEQ ID NO: 6545 - DNA, 1032 bp, Neisseria gonorrhoeae
ttgtcttcaccgtacaaacgctggcactatttcaacctgataaaaaacagccttcaaaaaggttgtttaaaacagcagcagacacttaccgccacaaccttgaaaaggaacacaatcatgaccgttatcaagcaagaagactttattcaaagtatctgcgatgccttccaattcatcagctactaccatccaaaagactacatcgacgcgctttataaggcgtggcagaaggaagaaaatcccgccgccaaagacgcgatgacgcagattttggtcaacagccgtatgtgtgccgaaaacaaccgccccatctgccaagacacaggtatcgcaaccgtcttcctcaaagtcggtatggatgtgcaatgggatgcggacatgagcgtggaaaagatggttaacgaaggcgtacgccgcgcctacacttgggaaggcaacaccctgcgcgcttccgtcctcgccgatccggccggcaaacgccaaaacaccaaagacaacacccccgccgtcatccacatgagcatcgtgccgggcggtaaagtcgaagtaacctgcgcggcaaaaggcggcggctctgaaaacaaatccaaactcgctatgctcaacccttccgacaacatcgtcgattgggtattgaaaaccatcccgacgatgggcgcgggctggtgtcctcccggcatcttgggcatcggcatcggcggcacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgcgtcgaagac

SEQ ID NO: 6546 - protein, 344 aa, Neisseria gonorrhoeae
LSSPYKRWHYFNLIKNSLQKGCLKQQQTLTATTLKRNTIMTVIKQEDFIQSICDAFQFISYYHPKDYIDALYKAWQKEENPAAKDAMTQILVNSRMCAENNRPICQDTGIATVFLKVGMDVQWDADMSVEKMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVED

SEQ ID NO: 6547 - DNA, 105 bp, Neisseria gonorrhoeae
ttgttcatcaaccggtccacaatgaactgcctgctgatttctccctaccgcaaagcaacaggcaaagattacaaatatcaaaatccgaataaaacagtattttat

SEQ ID NO: 6548 - protein, 35 aa, Neisseria gonorrhoeae
LFINRSTMNCLLISPYRKATGKDYKYQNPNKTVFY

SEQ ID NO: 6549 - DNA, 807 bp, Neisseria gonorrhoeae
ttgatgaatatgaaaaaatggattgccgccgcccttgcctgttccgcactcgcgctgtctgcctgcggcggtcagggcaaagatgccgccgcgcctgccgccaaccccggcaaagtgtaccgcgtggcttccaacgccgagtttgccccctttgaatctttagactcgaaaggcaatgtcgaaggtttcgacgtggatttgatgaacgcgatggcgaaggcgggcaattttaaaatcgaattcaaacaccagccgtgggacagccttttccccgccttgaacaacggcgatgcggacgttgtgatgtcgggcgtaaccattaccgacgaccgcaaacagtctatggatttcagcgacccgtattttgaaatcacccaagtcgtcctcgttccgaaaggcaaaaaagtatcttcttccgaagatttgaaaaagatgaacaaagtcggcgtggttaccggccacacgggcgatttctccgtttccaaactcttgggcaacgacaatccgaaaatcgcgcgcttcgaaaacgtccccctgattatcaaagaactggaaaacggcggcttggattccgtggtcagcgacagcgcggtcatcgccaattatgtgaaaaacaacccggccaaaggaatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatctacgccaaatattttgccaaagagggcggacaggctgcgaaa

SEQ ID NO: 6550 - protein, 269 aa, Neisseria gonorrhoeae
LMNMKKWIAAALACSALALSACGGQGKDAAAPAANPGKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKVSSSEDLKKMNKVGVVTGHTGDFSVSKLLGNDNPKIARFENVPLIIKELENGGLDSVVSDSAVIANYVKNNPAKGMDFVTLPDFTTEHYGIAVRKGDEATVKMLNDALEKVRESGEYDKIYAKYFAKEGGQAAK

SEQ ID NO: 6551 - DNA, 948 bp, Neisseria gonorrhoeae; identical to SEQ ID NO: 2249

SEQ ID NO: 6552 - protein, 316 aa, Neisseria gonorrhoeae; identical to SEQ ID NO: 2250

SEQ ID NO: 6553 - DNA, 591 bp, Neisseria gonorrhoeae
ttgtacggcagccgccgtttgccatgcgcccaaacagatgcggatggcgcgcaaaaaaagaccgccgcttacaaaggacaagacccggccaaagtaacgcattatttgacacggccggccggattttccgactgccaacgcgtttgtccggatgaaacaggattcgaccgccgcctgttccgcccctatgcccgcagcctgaaagggcaaatggcgaaagcgcggataagtgggaaaagataccggcgcttatctttggtgtccgcacaagccgacaaccggccgattgctccggtggtttgtcaaaatacggtggccggggtcttttttgaagcgcggtttcagcaatgcctactgcccgcattggctcaaaaatcggtgattatttcagataatgcgcgatttcgccgtatgggtgccttacggggaacggcggaaaaattgggacataaggtattgcctcccgcaccttattcgcccgagcccaacccgattgagaaagtgtgggcgaatattaagcggtatctgcgaaccgttttgtctgattacgcccgatttgacgatgcactactgtcctattttgattttaat

SEQ ID NO: 6554 - protein, 197 aa, Neisseria gonorrhoeae; identical to SEQ ID NO: 896

SEQ ID NO: 6555 - DNA, 249 bp, Neisseria gonorrhoeae
atgggcagtatcgaacagcgtttggaatatctggaagaagcaaacgatgtgctgcgtatgcagaaccacgtcctgtccaccgccttcaaagccctgatccgcgcccttcccgcagacaccgccgaaatcgcggtcgagtcgattcagcttgcttttgaggacgccttggcagaattgagctatgaggacagcccgcatacggatttgttccacgacgttacttatgcgtttttccgtgaaaaggaacgt

SEQ ID NO: 6556 - protein, 83 aa, Neisseria gonorrhoeae
MGSIEQRLEYLEEANDVLRMQNHVLSTAFKALIRALPADTAEIAVESIQLAFEDALAELSYEDSPHTDLFHDVTYAFFREKER

SEQ ID NO: 6557 - DNA, 123 bp, Neisseria gonorrhoeae
atgatgaatccttatgaatctgttaaaatgcgccattatatcaaactgcgctttgggcgcgggtttgcccgcctgcaaagattaagaaccggaagccgaaaaaatggatacaaacaatcagga

SEQ ID NO: 6558 - protein, 41 aa, Neisseria gonorrhoeae
MMNPYESVKMRHYIKLRFGRGFARLQRLRTGSRKNGYKQSG

SEQ ID NO: 6559 - DNA, 768 bp, Neisseria gonorrhoeae
atggatacaaacaatcaggataaagagccgaattgggaaaaacgcctggaaaacctgcgtcagacgcgccgtatgaataccgcgcctgcctatgtgccgctgaccaaaccttctgaagtcggaaaggaagagcccataccgaaattggacgatgcaaaccgagaccgtgtgttaaaggcgtatctgaagaaatggcaggaagaacacaacagcgccgttgccgattgcggcgaggaagtcgaaaccgacccgatgatcgtccttcaggaaaactggctcaacgcgcaggcttccctgcaaatgccggtttcggaaaaacacatcgaatcgcggcggagaatccggttcgatgccaaaaaagacagtgccgaatttgaaaccgcacagattgagggcggggaaaacgccgatgcggcagaatccggtacggcggcagacggggttgcggaaaacggcgaaggcggtgcggaagaggcgttgatgcccgtccaaatcaatatcctgaacccgaaagccgtcaaccggcgcgaagtgttctgcctgtccgaacaggagctgaccgaacggttgatcaaacgcctgcgcccgcatctgaccgataccgtcaacggcatgatccgtacggcggtgcagaagcagatggcgctctttacttatcagctccagcaaatgctgcacgagcaggcgggtgcggtagtcgaagacgtgttggaacacgatgtccgtaaaatcctcaacgacatcaagtacgaattaaaatacaaacgc

SEQ ID NO: 6560 - protein, 256 aa, Neisseria gonorrhoeae
MDTNNQDKEPNWEKRLENLRQTRRMNTAPAYVPLTKPSEVGKEEPIPKLDDANRDRVLKAYLKKWQEEHNSAVADCGEEVETDPMIVLQENWLNAQASLQMPVSEKHIESRRRIRFDAKKDSAEFETAQIEGGENADAAESGTAADGVAENGEGGAEEALMPVQINILNPKAVNRREVFCLSEQELTERLIKRLRPHLTDTVNGMIRTAVQKQMALFTYQLQQMLHEQAGAVVEDVLEHDVRKILNDIKYELKYKR

SEQ ID NO: 6561 - DNA, 123 bp, Neisseria gonorrhoeae
gtgcacccgttgtttaatttattaatattttgcgcctgttccatgaggctttcaagtcggacgggcaggaaaatgccgtctgaacacggctttcagacggcatggcaatcagcgtttgtattt

SEQ ID NO: 6562 - protein, 41 aa, Neisseria gonorrhoeae
VHPLFNLLIFCACSMRLSSRTGRKMPSEHGFQTAWQSAFVF

SEQ ID NO: 6563 - DNA, 1158 bp, Neisseria gonorrhoeae
atgagcaaaaaacttcatccgcaaacgctcgccatacgcggcggcaaagaacaaaccggataccgcgaacacaatcaggcattgttcctgaccagcagcttcatgtgggacaacgcccaacacgctgccgatttgttttcaaaaaaaatcaaaggcttcacttatacccgtaccgccaacccgaccatcgcggcctttgaaaaacgcatagccgctttggaaggcgcggaacgcgcggtcgccacttcgaccggcatgtccgcgattcaggcggcgtttttcaccttcctgcaggcgggcgaccatgtggtttccagccgcagcctgttcggcacgaccgtcggctttatcaataacatcgttaccaaattcggcatcggagtgagccgcgtgtcgccgactgatataaatgaatggaaagccgccgtcaaagccaacaccaaactgctgtttttggaaacgccgtccaaccccttgggcgaagtggccgacttggaagccttggcggaattggcgcacggcatcggcgcgctcttggtggtggacaacagcctgctgtcgcccgtcggctcgcagcctttgaaacacggcgcggatatttccgtttcctccgccaccaaagccatagacggacacgggcgcgtgatgggcggcgtgttggcgggttcggaagaactgatggcgcaggtcgccgtttactgcaactcttgcggtttggcgatgtcgccgtttaacgcgtggcagttgttgagcggcgtggaaaccctgtcgctgcgtatggaaaaacagtttgacaacgccttgagaatcgcgcaatggctgcaagagcagccgcaggttcaagcagtgtactacaccggattgcccgaccatccgcaggcggagcttatccgcaaacagcaaaacggcggcggcatcgtcatcggttttgaagtcgccgaccaagcagccgcgtggaaagtcgtggaactcttttcccgtaccgccaacctcggcgacgtgcgctcgaccatcaccaatccgtggacaaccacgcacggcaggatgcagcccgaagaaaaactcgccgccggtatccgccccggactggtgcgcctgtcggtcggtttggaatatgttggcgatttgattgacgatttgaaacaggcactcgcgcgc

SEQ ID NO: 6564 - protein, 386 aa, Neisseria gonorrhoeae
MSKKLHPQTLAIRGGKEQTGYREHNQALFLTSSFMWDNAQHAADLFSKKIKGFTYTRTANPTIAAFEKRIAALEGAERAVATSTGMSAIQAAFFTFLQAGDHVVSSRSLFGTTVGFINNIVTKFGIGVSRVSPTDINEWKAAVKANTKLLFLETPSNPLGEVADLEALAELAHGIGALLVVDNSLLSPVGSQPLKHGADISVSSATKAIDGHGRVMGGVLAGSEELMAQVAVYCNSCGLAMSPFNAWQLLSGVETLSLRMEKQFDNALRIAQWLQEQPQVQAVYYTGLPDHPQAELIRKQQNGGGIVIGFEVADQAAAWKVVELFSRTANLGDVRSTITNPWTTTHGRMQPEEKLAAGIRPGLVRLSVGLEYVGDLIDDLKQALAR

SEQ ID NO: 6565 - DNA, 99 bp, Neisseria gonorrhoeae
ttgcgtgtttcagacggcatcggcggaaaaatgcggcagatgccgtctgaaacccttattgcgtatggcatacacatcaacaataggaaaaaatatgga

SEQ ID NO: 6566 - protein, 33 aa, Neisseria gonorrhoeae
LRVSDGIGGKMRQMPSETLIAYGIHINNRKKYG

SEQ ID NO: 6567 - DNA, 204 bp, Neisseria gonorrhoeae
atggatgaagcggtttttgccgattgggcgttgaaaatctgcctgaccggtttgattatttttttgggttttatcgtttggaatttgggcaaggagtccaaagcgggcaaattcggcatcgccgttttgtttttggttttgggcttgggtgtgttcggttttgtgttcaaagagttattgattaagtttttggtattgcccaaa

SEQ ID NO: 6568 - protein, 68 aa, Neisseria gonorrhoeae
MDEAVFADWALKICLTGLIIFLGFIVWNLGKESKAGKFGIAVLFLVLGLGVFGFVFKELLIKFLVLPK

SEQ ID NO: 6569 - DNA, 414 bp, Neisseria gonorrhoeae
ttgcggaaagatgatttttattttgtcataaaaacccgcaccttaatcagttggcggttaaatcaaacttttagggtgcagattactttttatgatttcagacggcatttcgacagacggcaaacctatttgggcaataccaaaaacttaatcaataactctttgaacacaaaaccgaacacacccaagcccaaaaccaaaaacaaaacggcgatgccgaatttgcccgctttggactccttgcccaaattccaaacgataaaacccaaaaaaataatcaaaccggtcaggcagattttcaacgcccaatcggcaaaaaccgcttcatccatattttttcctattgttgatgtgtatgccatacgcaataagggtttcagacggcatctgccgcatttttccgccgatgccgtc

SEQ ID NO: 6570 - protein, 138 aa, Neisseria gonorrhoeae
LRKDDFYFVIKTRTLISWRLNQTFRVQITFYDFRRHFDRRQTYLGNTKNLINNSLNTKPNTPKPKTKNKTAMPNLPALDSLPKFQTIKPKKIIKPVRQIFNAQSAKTASSIFFPIVDVYAIRNKGFRRHLPHFSADAV

SEQ ID NO: 6571 - DNA, 303 bp, Neisseria gonorrhoeae
ttggtggaaatcccgaataagcggttcaaaacgtgtcgctgccgcggcagccatatacagttggcaactgtccggttgtgccgatgggttgccctgccgctccctgagctacgcaacggttgtctgccttgggcgggcgcgggtggcggccgggcggtttgtcgctatgatacggaagttccgatatacaagggcgggcttcagcccgccaaatccaccaactccgccgaatccaccgattcccgccgccgtcattcccgcataagcgggaatccagacctgtcggtgcggaaacttatcgga

SEQ ID NO: 6572 - protein, 101 aa, Neisseria gonorrhoeae
LVEIPNKRFKTCRCRGSHIQLATVRLCRWVALPLPELRNGCLPWAGAGGGRAVCRYDTEVPIYKGGLQPAKSTNSAESTDSRRRHSRISGNPDLSVRKLIG

SEQ ID NO: 6573 - DNA, 222 bp, Neisseria gonorrhoeae
atgtttattttctatactgtcaatcccgaacacgtatatttccccaaagcatacatcatgaaagtgttcaaggataaaggctacgaatcccaatgcatcacaacagtttctttttatatctgcaatccgactttgaagcaaaagaccgaaaacgaagcgtatgaatacggcagattgtttgttaaagaactgatgcataaggaatgcaaccgtgaaagcctt

SEQ ID NO: 6574 - protein, 74 aa, Neisseria gonorrhoeae
MFIFYTVNPEHVYFPKAYIMKVFKDKGYESQCITTVSFYICNPTLKQKTENEAYEYGRLFVKELMHKECNRESL

SEQ ID NO: 6575 - DNA, 1269 bp, Neisseria gonorrhoeae
gtgaaagcctttgaagataaagccttggcggtgtccgcggacatggcggacgcgttagcggacggcggggctgcggcaaccgccgtaggctgcccccctaggctaatagggggggagcaaaataaaaccccaaatccgaagggtgcggaaaaaacagaaaaccaagaatttcaattcgagtatttcagtcattttgtatcggacggcaaaggcagatttatagaaataccgttaaggcgtggcagggatgacggagcgttcatagaccaaatcactttcacgatacatgaaaattccatgacgaaagtaaccggaaagggattggtatcagatacggaattcgttgtccggtatagcgagctgcttgaagaaatcttgggattcggcattaccaaaaaattaccgtttaaaggaaagtttttctatcaaagctgttatcaattcgggcccgataacgtcgaatacggaaaggttcattacggcggccaatgtgaaacgatgttggttgaattgaacggtacaggctgcatggctgctttacccggttgggaaaaccgattgtatgaatttttaagtaaatgcgtccgacccaaaataacccgtatcgatgtcgcccatgattttttcaacggagagtacacacccgatcaggcaatgttagaccacgataacggacattacgacgtacacaatatgcggccaaaaagcgaatgtcgcggcacggcatggcgcaatgaagacggcagtggaaaaaccttttacatcggcaagcgcggaaattcaaaatttacccgtgtttacgagaaaggcagacagcttggagatgttgatagcccttgggtcaggtttgagggggatatagaaatacccttggatgtcctactttattcggggtcgtatctaggcggcgcatatccgatttgcaaggagatttttaagacagaagccaagcgcatggaagtaaaagttaaaaacgttaatctgatattcgacgttaagctttttcatgcaaggaatcaagtcggcaagatggttaatttcctccgcgatatagggtgggacgatagcaggatagttgatgagctggtgaaaggcgttgaaggttatccaaaaggtttacagcctgagcaatacgattgcaaaaaccaaacgcagaaattccagtatatccacgaagaacagaaagccattaacgcattgaacattgaaacactgtttgatgatttgattgaagagagagaatgcgcatttcctcaagacagggaatgg

SEQ ID NO: 6576 - protein, 423 aa, Neisseria gonorrhoeae
VKAFEDKALAVSADMADALADGGAAATAVGCPPRLIGGEQNKTPNPKGAEKTENQEFQFEYFSHFVSDGKGRFIEIPLRRGRDDGAFIDQITFTIHENSMTKVTGKGLVSDTEFVVRYSELLEEILGFGITKKLPFKGKFFYQSCYQFGPDNVEYGKVHYGGQCETMLVELNGTGCMAALPGWENRLYEFLSKCVRPKITRIDVAHDFFNGEYTPDQAMLDHDNGHYDVHNMRPKSECRGTAWRNEDGSGKTFYIGKRGNSKFTRVYEKGRQLGDVDSPWVRFEGDIEIPLDVLLYSGSYLGGAYPICKEIFKTEAKRMEVKVKNVNLIFDVKLFHARNQVGKMVNFLRDIGWDDSRIVDELVKGVEGYPKGLQPEQYDCKNQTQKFQYIHEEQKAINALNIETLFDDLIEERECAFPQDREW

SEQ ID NO: 6577 - DNA, 309 bp, Neisseria gonorrhoeae
atgtttgaaacaagccaagtaaccacatataccgccactttgttgggcgcaaaaaaattcaaaggcgaaatcgacggtaacaaaatcgattcatgcaccgtcttggtagccagccccatgccgtcaaacggcaatgccgtgggctttacctcggaaagcatgaagtttggtgacagccataattttgaaaaattgaaaaaccttaaattcccctgtgcggttgatctaaccgttgccatggaatcaacaggaaaaggcttagtgcagaaattgttggatttccaagtaaagggcgcagcacctaaagcc

SEQ ID NO: 6578 - protein, 103 aa, Neisseria gonorrhoeae
MFETSQVTTYTATLLGAKKFKGEIDGNKIDSCTVLVASPMPSNGNAVGFTSESMKFGDSHNFEKLKNLKFPCAVDLTVAMESTGKGLVQKLLDFQVKGAAPKA

SEQ ID NO: 6579 - DNA, 201 bp, Neisseria gonorrhoeae
atgagcagataccaacagaaatttatcgtacaggaattggaaaatcacgaattcatctatcccgattcgtttggcgatattggatttacgtcgaacatcaaatcagccggtaaatatgacagctatgaagacgcttttagctcggcattggaagagataggcggggaatttgtaattttcggattctacgaaaaagaagat

SEQ ID NO: 6580 - protein, 67 aa, Neisseria gonorrhoeae
MSRYQQKFIVQELENHEFIYPDSFGDIGFTSNIKSAGKYDSYEDAFSSALEEIGGEFVIFGFYEKED

SEQ ID NO: 6581 - DNA, 216 bp, Neisseria gonorrhoeae
atgaaatttattaacacctgccgtaaatacggcgcaaaactggctgttgtaacagccgccccgctggctttggcggcacaggcaaacgcagcgttgcccgaaacggcaaaaaacgctttggaagccgcaaaagcggacggtatggaagccggttggattgtagtgggcgttttcgccgcgctttttgtattttccatcgttaagagggtgatgaag

SEQ ID NO: 6582 - protein, 72 aa, Neisseria gonorrhoeae
MKFINTCRKYGAKLAVVTAAPLALAAQANAALPETAKNALEAAKADGMEAGWIVVGVFAALFVFSIVKRVMK

SEQ ID NO: 6583 - DNA, 411 bp, Neisseria gonorrhoeae
atgccgccttacttcatcaccctcttaacgatggaaaatacaaaaagcgcggcgaaaacgcccactacaatccaaccggcttccataccgtccgcttttgcggcttccaaagcgttttttgccgtttcgggcaacgctgcgtttgcctgtgccgccaaagccagcggggcggctgttacaacagccagttttgcgccgtatttacggcaggtgttaataaatttcatgatattttcctttacgaaatttttaaaaaaatgtgtttgcgggctttgtgaaggttttagagaccgcctgccgggcctcttaaacttaatcttctttttcgtagaatccgaaaattacaaattccccgcctatctcttccaatgccgagctaaaagcgtcttcatagctgtcatatttaccggc

SEQ ID NO: 6584 - protein, 137 aa, Neisseria gonorrhoeae
MPPYFITLLTMENTKSAAKTPTTIQPASIPSAFAASKAFFAVSGNAAFACAAKASGAAVTTASFAPYLRQVLINFMIFSFTKFLKKCVCGLCEGFRDRLPGLLNLIFFFVESENYKFPAYLFQCRAKSVFIAVIFTG

SEQ ID NO: 6585 - DNA, 165 bp, Neisseria gonorrhoeae
caggatagcgattcgtagcaactgcatccaacccccccccccgaacaactccccaaacaacgccgcgcgccccgggcgtttgccgtttccctgcaaaatctgcgatacaatgcagtctgaacatttatccgaatcccaaacccgatggataccgcacaaaaacaa

SEQ ID NO: 6586 - protein, 5 aa, Neisseria gonorrhoeae
QDSDS

SEQ ID NO: 6587 - DNA, 312 bp, Neisseria gonorrhoeae
gtgcttctcaagacatttatttccgacttggcagtacatgccgccttacttcatcaccctcttaacgatggaaaatacaaaaagcgcggcgaaaacgcccactacaatccaaccggcttccataccgtccgcttttgcggcttccaaagcgttttttgccgtttcgggcaacgctgcgtttgcctgtgccgccaaagccagcggggcggctgttacaacagccagttttgcgccgtatttacggcaggtgttaataaatttcatgatattttcctttacgaaatttttaaaaaaatgtgtttgcgggctttg

SEQ ID NO: 6588 - protein, 104 aa, Neisseria gonorrhoeae
VLLKTFISDLAVHAALLHHPLNDGKYKKRGENAHYNPTGFHTVRFCGFQSVFCRFGQRCVCLCRQSQRGGCYNSQFCAVFTAGVNKFHDIFLYEIFKKMCLRAL

SEQ ID NO: 6589 - DNA, 795 bp, Neisseria gonorrhoeae
atggataccgcacaaaaacaacgctgggcaataaccctatcctacgacggcagccgcttttacggctggcagaaacaggcgggcggcgtaccgaccgttcaggcggcattggaaaccgcactcgcccgaatcgcaggagaatctgtcgccaccacagttgccggcaggaccgacaccggcgttcatgcgactgcccaagtcgttcatttcgatactgccgccgtacgtcccgctcaggcatggatacgcggcgtaaacgcccacctgcccgaaggcatagccgttttgcacgcccgacaggtcgcacccggatttcacgcacgcttcgacgcatccggacggcactaccgctacctgctcgaatccgcccccgtccgttcccccctgctcaaaaacagggcgggctggacacacctcgagctcgacatcggaccgatgcgccgggctgccgccttattggtcggcgaacaagacttctccagcttccgcgccgccgggtgccaggcaaaatcccccgtcaaaaccatctaccgcgccgaccttacccaaagcgcgggactcgtgcgcctcgatttgcacggcaacgcctttttgcaccacatggtacgcaacatcatgggcgcgctcgtttatgtcggcagcggcaggctcagcgtcgaaggcttcgccgcactgattcaagaacgcagccgcctcaaagccccaccgacctttatgcccgacgggctttacctgaccggcgtcgactatcccggggcatacggcatcgtccgcccccaaatccccgaatggctt

SEQ ID NO: 6590 - protein, 265 aa, Neisseria gonorrhoeae
MDTAQKQRWAITLSYDGSRFYGWQKQAGGVPTVQAALETALARIAGESVATTVAGRTDTGVHATAQVVHFDTAAVRPAQAWIRGVNAHLPEGIAVLHARQVAPGFHARFDASGRHYRYLLESAPVRSPLLKNRAGWTHLELDIGPMRRAAALLVGEQDFSSFRAAGCQAKSPVKTIYRADLTQSAGLVRLDLHGNAFLHHMVRNIMGALVYVGSGRLSVEGFAALIQERSRLKAPPTFMPDGLYLTGVDYPGAYGIVRPQIPEWL

SEQ ID NO: 6591 - DNA, 1536 bp, Neisseria gonorrhoeae; identical to SEQ ID NO: 2283

SEQ ID NO: 6592 - protein, 512 aa, Neisseria gonorrhoeae; identical to SEQ ID NO: 2284

SEQ ID NO: 6593 - DNA, 1338 bp, Neisseria gonorrhoeae
atgttgaatccatcccgaaaactggttgagctggtccgtattttggatgaaggcggttttattttcagcggcgatcccgtgcaggcgacggaggctttgcgccgcgtggacggcagtacggaggaaaaaatcatccgtcgggcggagatgatcgacagggaccgtatgctgcgggacacgttggaacgtgtgcgtgcggggtcgttctggttatgggtggtggtggcatcgatgatgtttaccgccggattttcaggcacttatcttctgatggacaatcaggggctgaatttctttttagttttggcgggagtgttgggcatgaatacgctgatgctggcagtatggttggcaacgttgttcctgcgcgtgaaagtgggacggtttttcagcagtccggcgacgtggtttcggggcaaaggccctgtaaatcaggcggtgttgcggctgtatgcggaccagtggcggcaaccttcggtacgatggaaaataggcgcaacggcgcacagcttgtggctctgcacgctgctcggaatgctggtgtcggtattgctgctgcttttggtgcggcaatatacgttcaactgggaaagcacgctgttgagcaatgccgcttcggtacgcgcggtggaaatgttggcatggctgccgtcgaaactcggtttccctgtccccgatgcgcgggcggtcatcgaaggtcgtctgaacggcaatattgccgatgcgcgggcttggtcggggctgctggtcggcagtatcgtctgctacggcatcctgccgcgcctcttggcttgggtagtgtgtaaaatccttttgaaaacaagcgaaaacggattggatttggaaaaaacctattatcaggcggtcatccgccgctggcagaacaaaatcaccgatgcggatacgcgtcgggaaaccgtgtccgccgtttcgccgaaaatcgtcttgaacgatgcgccgaaatgggcgctcatgctggagaccgagtggcaggacggccaatggttcgagggcaggctggcgcaggaatggctggataagggcgttgccgccaatcgggaacaggttgccgcgctggagacagagctgaagcagaaaccggcgcaactgcttatcggcgtacgcgcccaaactgtgccggaccggggcgtgctgcggcagattgtgcggctttcggaagcggcgcagggcggcgcggtggtgcagcttttggcggaacaggggctttcagacgacctttcggaaaagctggaacattggcgtaacgcgctgaccgaatgcggcgcggcgtggcttgagcctgacagggtggcgcaggaaggccgtttgaaagaccaa

SEQ ID NO: 6594 - protein, 446 aa, Neisseria gonorrhoeae
MLNPSRKLVELVRILDEGGFIFSGDPVQATEALRRVDGSTEEKIIRRAEMIDRDRMLRDTLERVRAGSFWLWVVVASMMFTAGFSGTYLLMDNQGLNFFLVLAGVLGMNTLMLAVWLATLFLRVKVGRFFSSPATWFRGKGPVNQAVLRLYADQWRQPSVRWKIGATAHSLWLCTLLGMLVSVLLLLLVRQYTFNWESTLLSNAASVRAVEMLAWLPSKLGFPVPDARAVIEGRLNGNIADARAWSGLLVGSIVCYGILPRLLAWVVCKILLKTSENGLDLEKTYYQAVIRRWQNKITDADTRRETVSAVSPKIVLNDAPKWALMLETEWQDGQWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRVAQEGRLKDQ

SEQ ID NO: 6595 - DNA, 195 bp, Neisseria gonorrhoeae
ttgatggttcggatgccgtctgaaaggtgtatccgaaaggcgttaatatacagcggaaccctagcaaacgccatcatgctgtttcaggcggcattttttcttataaaaacctttcagcaacaatatattgccaaactgcaaaccaaactgcttttgataactgccgaccttccctctaaaatacgttcgaatttt

SEQ ID NO: 6596 - protein, 65 aa, Neisseria gonorrhoeae
LMVRMPSERCIRKALIYSGTLANAIMLFQAAFFLIKTFQQQYIAKLQTKLLLITADLPSKIRSNF

SEQ ID NO: 6597 - DNA, 105 bp, Neisseria gonorrhoeae
atgccgatatcctttttcggaaaacgctttttccgcgcctatatccgggcgcgcatcgcccgcgtccgcaccggccggacgggctgccgcatcaccaatgccgtc

SEQ ID NO: 6598 - protein, 35 aa, Neisseria gonorrhoeae
MPISFFGKRFFRAYIRARIARVRTGRTGCRITNAV

SEQ ID NO: 6599 - DNA, 294 bp, Neisseria gonorrhoeae; identical to SEQ ID NO: 2159

SEQ ID NO: 6600 - protein, 98 aa, Neisseria gonorrhoeae; identical to SEQ ID NO: 2160

SEQ ID NO: 6601 - DNA, 1044 bp, Neisseria gonorrhoeae
atgaaaaaatccctgattgccctgactttggcagcccttcctgttgcggcaatggccgatgtcaccctgtacggcgccatcaaagccggcgtacaaacttaccgttctgtagaacatacagacggcaaggtaagtaaagtggaaaccggcagcgaaatcgccgacttcggttcaaaaatcggcttcaaaggccaagaagacctcggcaacggcctgaaggccgtttggcagttggaacaaggtgcctccgtcgccggcactaacaccggctggggcaacaaacaatccttcgtcggcttgaagggcggcttcggtaccatccgcgccggtagcctgaacagccccctgaaaaacaccggcgccaacgtcaatgcttgggaatccggcaaatttaccggcaatgtgctggaaatcagcggaatggcccaacgggaacaccgctacctgtccgtacgctacgattctcccgaatttgccggcttcagcggcagcgtacaatacgcacctaaagacaattcaggctcaaacggcgaatcttaccacgttggcttgaactaccaaaacagcggcttcttcgcgcaatacgccggcttgttccaaagatacggcgaaggcactaaaaaaatcgaatacgatggtcaaacttatagtatccccagtctgtttgttgaaaaactgcaagttcaccgtttggtaggcggttacgacaataatgccctgtacgtttccgtagccgcacaacaacaagatgccaaattgtatggagcaatgagcggtaattcgcacaactctcaaaccgaagttgccgctaccgcggcataccgtttcggcaatgtaacgccccgcgtttcttacgcccacggcttcaaaggcactgttgatagtgcaaaccacgacaatacttatgaccaagtggttgtcggtgcggaatacgacttctccaaacgcacttctgccttggtttctgccggctggttgcaagaaggcaaaggcgcagacaaaatcgtatcgactgccagcgccgtcgttctgcgccacaaattc

SEQ ID NO: 6602 - protein, 348 aa, Neisseria gonorrhoeae
MKKSLIALTLAALPVAAMADVTLYGAIKAGVQTYRSVEHTDGKVSKVETGSEIADFGSKIGFKGQEDLGNGLKAVWQLEQGASVAGTNTGWGNKQSFVGLKGGFGTIRAGSLNSPLKNTGANVNAWESGKFTGNVLEISGMAQREHRYLSVRYDSPEFAGFSGSVQYAPKDNSGSNGESYHVGLNYQNSGFFAQYAGLFQRYGEGTKKIEYDGQTYSIPSLFVEKLQVHRLVGGYDNNALYVSVAAQQQDAKLYGAMSGNSHNSQTEVAATAAYRFGNVTPRVSYAHGFKGTVDSANHDNTYDQVVVGAEYDFSKRTSALVSAGWLQEGKGADKIVSTASAVVLRHKF

SEQ ID NO: 6603 - DNA, 957 bp, Neisseria gonorrhoeae; identical to SEQ ID NO: 2323

SEQ ID NO: 6604 - protein, 319 aa, Neisseria gonorrhoeae; identical to SEQ ID NO: 2324

SEQ ID NO: 6605 - DNA, 1509 bp, Neisseria gonorrhoeae
atgagcgaacaaaaccatccgcaaaccgagccgcagttggacgaaaaccaaatcatcgccctgcgccgcgaaaaactgaacaacatccgccaacagcgcaacgcttatcccaacgatttcaagcgcgacagctttgccgccgatttgcaggcgcaatacggcgaaatcggcaaagaagaactcgacccgcaggccgttcccgttaaaattgccggccgcatgatgctcaaacgtcaaatgggcaaagccagcttcgccaccattcaagacgttaccggtcaaatccagctttatctgaacaacaaaggcgtgagccaagaagttttggacgacttcaaccactgggacttgggcgacatcgtcggtgcggaaggcactttgttcaaaaccaaccacggcgaactaaccgtgcgtgtgtccgacatccgcctgctgtccaaatccctgcgtccgctgcccgacaaacacaaaggcttgagcgatcaggaaaccaaataccgccaacgctacgtcgatttgattgccaatgaagaatcgcgcaatacctttatcaaacgcagccaaatcatccaatctgtgcgtaattttatggtgggcgagcattatctcgaagtcgaaaccccgatgatgcacccgattcccggcggcgcgacagcgaaacccttcgttacccaccacaatgccttggacattccgctctacctgcgcatcgcgcccgagctgtatctgaaacgcttggtggtcggcggcttggaacgcgtgtttgaaatcaaccgcagcttccgtaacgagggcatgtccgtgcgccacaaccccgaatttacgatgattgaattttacgaagccttctccgactacgaacgtatgatgcagatggcggaagacatcatccgcaacgcatcgcgcacggtaaacggcacggcaaacatcacttacaacggcaaagaagtcgatttggaaagcccgttcgaacgtctgaccatcctcgaagccatcaaaaaatacaatccgcactacaccgacgagcagttgaacgatgcggaatggctgaaaaaagaaatcgtcaaacacggcgaaagcctgccgccgtccccgggcatcggcagcctgcaactcgccctgtttgaaggttgcgccgagggcaaactgtggaatccgacctttattgtcgattacccggtcgaagtttccccgttggcgcgcgcttcggatacgaaacaaggtctgaccgaacgcttcgagcttttcgttgtcgggcgcgaactggcaaacggctattccgagttgaacgaccccgaagaccaagccgaacgcttcaaatcgcaagtggcgcaaaaagatgcgggcgacgacgaagccatgcactacgatgccgactacatccgcgcgatggaattcggtttgccgccgaccggcggttgcggcatcggcatcgaccgcttagtgatgctgctgaccgatttgcaaaccatccgcgatgtgattctgtttccgcagatgcgtcccgag

SEQ ID NO: 6606 - protein, 503 aa, Neisseria gonorrhoeae
MSEQNHPQTEPQLDENQIIALRREKLNNIRQQRNAYPNDFKRDSFAADLQAQYGEIGKEELDPQAVPVKIAGRMMLKRQMGKASFATIQDVTGQIQLYLNNKGVSQEVLDDFNHWDLGDIVGAEGTLFKTNHGELTVRVSDIRLLSKSLRPLPDKHKGLSDQETKYRQRYVDLIANEESRNTFIKRSQIIQSVRNFMVGEHYLEVETPMMHPIPGGATAKPFVTHHNALDIPLYLRIAPELYLKRLVVGGLERVFEINRSFRNEGMSVRHNPEFTMIEFYEAFSDYERMMQMAEDIIRNASRTVNGTANITYNGKEVDLESPFERLTILEAIKKYNPHYTDEQLNDAEWLKKEIVKHGESLPPSPGIGSLQLALFEGCAEGKLWNPTFIVDYPVEVSPLARASDTKQGLTERFELFVVGRELANGYSELNDPEDQAERFKSQVAQKDAGDDEAMHYDADYIRAMEFGLPPTGGCGIGIDRLVMLLTDLQTIRDVILFPQMRPE

SEQ ID NO: 6607 - DNA, 195 bp, Neisseria gonorrhoeae
ttgcggatggttttgttcgctcatagggttttccgaaaaaataaatcaggcgcagtctgtttcagacgacctgaccgaatcacaaaatttgcgcgtattttacgcgatgtcggtgtttttttccaagaaagggcgatgccgtctgaaaatcttgcagacggcattcagattttgaaacctatgccaaaagtccgg

SEQ ID NO: 6608 - protein, 65 aa, Neisseria gonorrhoeae
LRMVLFAHRVFRKNKSGAVCFRRPDRITKFARILRDVGVFFQERAMPSENLADGIQILKPMPKVR

SEQ ID NO: 6609 - DNA, 918 bp, Neisseria gonorrhoeae
gtcgtggataaaacttaccccgtgaagctgcgactgcataatcgccgccttcatcgccgacaacgccttcggacggacaaaattacggcgatacgccaatacgacccgccggcttggcggcgtaccttcaaacggaataatgctgaacagcatatgatcgttctcggtcagcgcggttgccggcaacacgctgattgccaaaccgctggcgaccatatggcggattgtattgatcgagctgccctgcaatgtattggtcagcccctgtatgcgctgtttcgccgccaattcggaacagcttgagagtacctgatcccgcatacagttgccttccgtcagcagcaaaacctgctcctcacccagcatccggggcgaaacggcatccagttcctcaaatgaatgccctttcgggacaatcacgaaaaacggttcgtcatacaagggttcggtaacaatgcccggctcttgaaacggttcggcaacgataatcgcgtcaacgtccccgcgtttgagcgactcggtcaaagtatgcgtgtaattctcttccaacatcaaaggcattttcggtgcagtacggcgcaacgagacaatcagtttcggcagcaggtatggcgcaaccgtaaaaatcagcccgagtttgaacgcaccctccagctcgttttgttcttcatttgccaaatgcctgataagctccgcctctttcaataccttacgcgcctgtgcaacgatacgttcccccgcctcggtcgtaataatatcgttgctgctccggtcaaacaaagagacggcaagctcttcttccaatttcttaatggcaatagacaaagtgggctggctgacaaaacaacgccgcgccgcccggccgaaatgacgttcttgggcgactgcgacgatgtaccgcaattcggttaaggtcat

SEQ ID NO: 6610 - protein, 100 aa, Neisseria gonorrhoeae
VVDKTYPVKLRLHNRRLHRRQRLRTDKITAIRQYDPPAWRRTFKRNNAEQHMIVLGQRGCRQHADCQTAGDHMADCIDRAALQCIGQPLYALFRRQFGTA

SEQ ID NO: 6611 - DNA, 1251 bp, Neisseria gonorrhoeae
atgtccgaacaacatatttcgacttggaaaagcaagatcaacgcattgggaccggggattatgatggcttcggcggctgtcggcggttcgcacctgattgcctcgacgcaggcgggcgcgctttacggctggcagctcgcgctcatcatcatcctgaccaacctcttcaaatacccgtttttccgcttcagcgcgcattacactctggacacgggcaagagtctgattgaaggttatgccgagaaaagctgcgtttatttgtgggtttttttgattttgtgtatcgcctccgccacgattaacgcgggcgcggtcgccattgtaaccgccgccatcgtcaaaatggcgattccctcgctgatgtttgatgccggcacggttgccgccttgattatggcatcctgcctgattattttggtgagcggacgttaccgcgctttggatcgtgtttccaaaatcatcattgttactttgagcatcgccacgcttgccgccgccggcatcgctatgtcgcgcggtatgcagatgcagcccgattttatcgagccgacaccgtggacgcttgccggtttgggcttcctgatcgcgctgatgggctggatgcccgcgccgatcgaaatttccgccatcaattctttgtgggtaaccgaaaaacaacgcatcaatccttctgaataccgcgacgggattttcgatttcaacgtcggttatatcgccagtgcggttttggctttggttttccttgcactgggcgcgtttgtgcaatacggcaacggcgaagcagtgcagatggcgggcggcaaatatatcgggcaattgattaatatgtatgccgtaaccatcggcggctggtctcgtccgctggtggcgtttatcgcgtttgcctgtatgtacggcacgacgattaccgttgtggacggttatgcgcgtgccattgccgaacccgtgcgcctgctgcgcggcagggataaaaccggcaacgccgagttgtttgcctggaatatttgggtggcgggcagcggtttggcggtgattttctggtttgacggcgcaatggcggaactgctcaaatttgcgatgattgccgcctttgtgtccgcccctgtgttcgcctggctcaactaccgcctcgtcaaaggggacaaacgccacaggcttaccgccggtatgaacgcccttgccattgtcggcctgctctacctggccgggtttgccgttttgttcctgttgaaccttaccggacttttggca

SEQ ID NO: 6612 - protein, 417 aa, Neisseria gonorrhoeae
MSEQHISTWKSKINALGPGIMMASAAVGGSHLIASTQAGALYGWQLALIIILTNLFKYPFFRFSAHYTLDTGKSLIEGYAEKSCVYLWVFLILCIASATINAGAVAIVTAAIVKMAIPSLMFDAGTVAALIMASCLIILVSGRYRALDRVSKIIIVTLSIATLAAAGIAMSRGMQMQPDFIEPTPWTLAGLGFLIALMGWMPAPIEISAINSLWVTEKQRINPSEYRDGIFDFNVGYIASAVLALVFLALGAFVQYGNGEAVQMAGGKYIGQLINMYAVTIGGWSRPLVAFIAFACMYGTTITVVDGYARAIAEPVRLLRGRDKTGNAELFAWNIWVAGSGLAVIFWFDGAMAELLKFAMIAAFVSAPVFAWLNYRLVKGDKRHRLTAGMNALAIVGLLYLAGFAVLFLLNLTGLLA

SEQ ID NO: 6613 - DNA, 156 bp, Neisseria gonorrhoeae
atgttgttcggacataaagtcttccgtatttttaactgtgtttcaacacacagagccgcatattcggacacagccctatctattgctccaatttgggcgggattgaccccaaacaaacccaaatcctaccgtcttcaaaaacaggataccgcccgg

SEQ ID NO: 6614 - protein, 52 aa, Neisseria gonorrhoeae
MLFGHKVFRIFNCVSTHRAAYSDTALSIAPIWAGLTPNKPKSYRLQKQDTAR

SEQ ID NO: 6615 - DNA, 261 bp, Neisseria gonorrhoeae
tacctttttctgttccggcaaagtaatgttcaactcaagcacatccataccatcctgcttttcttgggaaatacggatattgtctaatgaaacattcacatatttggacaggacttccatcaactctttacgtaaagtcggcaggtaatccggagtctgaccttcttgggcgcgctcttgggcaatgatgatttgaaggcggtcgcgggcaacggttgccgttttctgctttctaccgaataaaagttcgatcaatgacat

SEQ ID NO: 6616 - protein, 28 aa, Neisseria gonorrhoeae
YLFLFRQSNVQLKHIHTILLFLGNTDIV

SEQ ID NO: 6617 - DNA, 108 bp, Neisseria gonorrhoeae
ttgggcggcaacttcctgtgccttggtggcaaggattttattgaggatgtcggtcatgtcgtgttccgtatttgtccggggaaagggggaatattagcatcaaaccgt

SEQ ID NO: 6618 - protein, 36 aa, Neisseria gonorrhoeae
LGGNFLCLGGKDFIEDVGHVVFRICPGKGGILASNR

SEQ ID NO: 6619 - DNA, 510 bp, Neisseria gonorrhoeae; identical to SEQ ID NO: 2393

SEQ ID NO: 6620 - protein, 170 aa, Neisseria gonorrhoeae; identical to SEQ ID NO: 2394

SEQ ID NO: 6621 - DNA, 813 bp, Neisseria gonorrhoeae
tcctccgaacagacgtttgaagaagctttttttctcagcttccaagaaacgcatttcacggttctcgcccaaaagacgggcaataacgtccttatatgcctcggaagccgttacgctgtcctgatggatgaccggttctccggaattggatgcctgcaagacgttttgggattcgggaatcacacccagcaaaggaatacgcagaatatcgcaaatatcctgtacagacagcatttcgccttttgccacacgttcgggagaataacgcgtaattaacagatgttctttaaccgaaccgccttgctccgccttacgggatttgctttgcaaaattcccaaaatcctgtcggagtcacgcacactggaaacctcaggattggtcgttacaatggcttcatcagcaaaatacaacgccatcaatgcaccctgctcaataccagcaggagagtcgcaaataatatactcaaagcccattttcttgccggacagctcctgcatcactttttctacgccctcgcgtgtcaaagcgtctttatcccgagtctgggaagccggcaaaataaacaggttttcacaatttttatctttaatcaaagcctggttgagcgtcgcctcaccctgaatgacattgatcaggtcataaacgacacgacgctcgcaacccataatgaggtcgaggttgcgcaaacccacatcaaaatcaattaccgcagttttatatccgcgtaatgccaaacctgttgcaatacttgcactggtagtcgttttaccgacaccgcccttgcctgaagttactacaataatttttgccac

SEQ ID NO: 6622 - protein, 91 aa, Neisseria gonorrhoeae
SSEQTFEEAFFLSFQETHFTVLAQKTGNNVLICLGSRYAVLMDDRFSGIGCLQDVLGFGNHTQQRNTQNIANILYRQHFAFCHTFGRITRN

SEQ ID NO: 6623 - DNA, 198 bp, Neisseria gonorrhoeae
atgccttcttttggaagtaatacggaaaatatagtcaggtttgagcatgaagttctaatagtgtgtgttggcaggtatttggattacgttacaatacgcgctttcatcaaaatttccctaccgggcggtatcctgtttttgaagacggtaggatttgggtttgtttggggtcaatcccgcccaaattggagcaataga

SEQ ID NO: 6624 - protein, 66 aa, Neisseria gonorrhoeae
MPSFGSNTENIVRFEHEVLIVCVGRYLDYVTIRAFIKISLPGGILFLKTVGFGFVWGQSRPNWSNR

SEQ ID NO: 6625 - DNA, 744 bp, Neisseria gonorrhoeae
ctctgagccaattgcactgataaccaatcggttatcctgcaacaatatctgtaccggctgcttgtgcagatggtccggcaaatcctgttcaaaattacggtaaatccccgcgacagaaaccaactccgcctgcatggagtggataaatatgcgggcagaagtatcacctttggcgccggccaaagcacgccctctcatcggcgcataaatatgcatattgccatctgcaatcaattccgccccctggctgaccgcccccgtaacaatcaaatcgccatcttcggcataaacctgctgaccggtacggacaggggatgtaatcaatactgttttccttgctttctgaccatcctccgttttctgcacctcaacctgacccagttctttaacattttccgaatgagacagacaaaacagcaaatgatacttcatagccacagcagcccaacgttcattagaatgcttcagacccaaaatttgcataccatgccttgaaaacaacgaaaccaatgcagcaagatccaaagactcgggataatcaaattcttgaacatccagaacaaatggaacaacaccagactcttgaaacttcttgcccaatttgaccagcacatcttccaaatcaaacaagtctgatgtatgcaaagatatagacaatacgtccatctttgtcgactttatatcgaaggcattcattatataaaccatcatagaattttttaatgatgtaagtttaccgcgcaa

SEQ ID NO: 6626 - protein, 162 aa, Neisseria gonorrhoeae
ANCTDNQSVILQQYLYRLLVQMVRQILFKITVNPRDRNQLRLHGVDKYAGRSITFGAGQSTPSHRRINMHIAICNQFRPLADRPRNNQIAIFGINLLTGTDRGCNQYCFPCFLTILRFLHLNLTQFFNIFRMRQTKQQMILHSHSSPTFIRMLQTQNLHTMP

SEQ ID NO: 6627 - DNA, 1899 bp, Neisseria gonorrhoeae
ttgcagcaggctggcgatttgataatatggttatgtttttcagacggcatttcagatttccgtccatgccgtctgaagccgcgaaacctgattggaggatctgttatgaataccgtatcgaattacctgtccgcattgcgcgaagccatgaaggcgcaaggcttggacgcactcgtcatcccttccgccgacccccacctatccgaatacctgcccgagcattggcaggcgcggcgcgaattgtcaggctttaccggctcggtcggcacattcgtcgttaccgccgatgaagcgggcgtatgggtggacagccgctattgggaacaagccgccaaacagctttccggcagcggcattgagctgcaaaaaagcgggcaagtgccgccgtacaacgaatggctcgcggcaaacctgcccgaaaacgctgccgtcggcatcccttccgatatggtgtcgctcaccggcaaacgcactttggcgcaatcgctcgccgccaaaaacatccgcatccaacaccccgacgacctgcttgaccaagtgtggacaagccgtcccgctatccccgccgaaaccgtgttcatccacgaccacgcctacgtctccgaaaccgccgccgagaaactcgcccgcgtgcgcgcagttatggcggaaaaaggcgcggattaccacttggtttcctcgcttgacgacatcgcttggctgaccaacctgcgcggcagcgacgtgcctttcaaccctgttttcgtgtccttcctgctgatcggcaaagacagtgccgtcctgtttaccgaacaatgccgtctgaacgccgaagccgccgccgcgctacaaaccgcaggtatcacggtcgagccttacgcccaagttgccgacaaactcgcgcaaatcggcggcgcgctgctcatcgagccgaacaaaaccgccgtcagtacgctcgtgcgcctgcccgaaagcgcgcgcctgattgaaggcatcaacccgtccaccttcttcaaatccgtcaaatccgaagccgacatcgcccgcatccgcgaagcgatggaacaagacggcgcggcgttgtgcggcttcttcgccgagtttgaagacatcatcggcaaaggcggcagcctgaccgaaatcgacgtggatacgatgctttaccgccaccgcagcgcgcgcccgggttttgtgtccttgagtttcgacaccatcgcaggcttcaacgccaacggtgccctgccgcattacagcgcaacacccgaaagccacagcaccatcagcggcaacggtctgctgctcatcgactccggcgcgcaatacaaaggcggcacgaccgacatcacccgcgtcgtccccgtcggcacgcccacagcagaacaaaaacgcgacaacacgctcgttctcaaagcccatatcgcgcttgccgaagccgtgttccccgaaaacatcccctcgccgctgattgacgcgatttgccgcaaacccctgtggcaggcgcaatgcgactacggacacggcaccggccacggcgtaagctatttcctcaacgtccacgaaggcccgcagcgcatcgccttcgccgcccccgccacgcccgaaaccgccatgaaaaaaggcatggttacctccatcgaacccggcctctaccgtccggggaaatggggcatccgcattgaaaacctcgccgccaaccaagccgtcgccgacccgcaggaaaccgagttcggcagcttcctctgttttgaaaccctgaccctctgccccatcgatacacgcctgatggacaccgccctgatgaccgacggcgaaatcgactgggtcaaccgctaccacgccgaagtccgccgccgcctcgagccgctgaccgaaggcgcggcaaaagcgtggctgatcaaacgcaccgaaccgctggcgcgt

SEQ ID NO: 6628 - protein, 633 aa, Neisseria gonorrhoeae
LQQAGDLIIWLCFSDGISDFRPCRLKPRNLIGGSVMNTVSNYLSALREAMKAQGLDALVIPSADPHLSEYLPEHWQARRELSGFTGSVGTFVVTADEAGVWVDSRYWEQAAKQLSGSGIELQKSGQVPPYNEWLAANLPENAAVGIPSDMVSLTGKRTLAQSLAAKNIRIQHPDDLLDQVWTSRPAIPAETVFIHDHAYVSETAAEKLARVRAVMAEKGADYHLVSSLDDIAWLTNLRGSDVPFNPVFVSFLLIGKDSAVLFTEQCRLNAEAAAALQTAGITVEPYAQVADKLAQIGGALLIEPNKTAVSTLVRLPESARLIEGINPSTFFKSVKSEADIARIREAMEQDGAALCGFFAEFEDIIGKGGSLTEIDVDTMLYRHRSARPGFVSLSFDTIAGFNANGALPHYSATPESHSTISGNGLLLIDSGAQYKGGTTDITRVVPVGTPTAEQKRDNTLVLKAHIALAEAVFPENIPSPLIDAICRKPLWQAQCDYGHGTGHGVSYFLNVHEGPQRIAFAAPATPETAMKKGMVTSIEPGLYRPGKWGIRIENLAANQAVADPQETEFGSFLCFETLTLCPIDTRLMDTALMTDGEIDWVNRYHAEVRRRLEPLTEGAAKAWLIKRTEPLAR

SEQ ID NO: 6629 - DNA, 2301 bp, Neisseria gonorrhoeae; identical to SEQ ID NO: 2429

SEQ ID NO: 6630 - protein, 767 aa, Neisseria gonorrhoeae; identical to SEQ ID NO: 2430

SEQ ID NO: 6631 - DNA, 135 bp, Neisseria gonorrhoeae
ttcaattaatattttaaacatgatagccaataccatattatctatcagatattgcaaaaataacgccacctgcttttcggcagatggcgttatatgactaaaattactcagcagccggtttgtcaaccaattcaa

SEQ ID NO: 6632 - protein, 17 aa, Neisseria gonorrhoeae
YFKHDSQYHIIYQILQK

SEQ ID NO: 6633 - DNA, 705 bp, Neisseria gonorrhoeae
atgatacagcacggcaaccatgccgtctgcgtcgatccttccgaaccctcgcccgtcttggaattcctcgtacgcaaccgactcatgctcgcccaaacctgggtaacgcacccccatcccgaccacgaaggcggtgcggcggcactctggcgcggctacatggaatcgcccgtttacggcgaatccgacatcgaagccgccacccacaccgtaaccgccggcacacgattcaccttcggcaacggtcaggttaccgtttgggcaacacccggccacacagaccgccacaccagctaccttctcgaaacttcagacggcatacacgttttctgcggcgacacccttttttccgccggctgcggacgcgtgtttaccggcacggtcgaacagctttacgacaacttccaacggttcaaccaattacccgaaggcaccctgttctatccggcacacgaatacaccgccgccaacctgcgtttcgccgcccatatcgagccggacaacgccgacattcagacggcattgaaggcggcggaacacacgcccaccctgcccgttaccctcgcgcacgaacgccgcgtcaacccgttcttacggacagaaatccccgccgtccgccaacgtgccgaagccctggtcggcaaaacgctgaacagcggtttggaagtattcgccgccctgcgcgaactgaaaaacgcctaccgc

SEQ ID NO: 6634 - protein, 235 aa, Neisseria gonorrhoeae
MIQHGNHAVCVDPSEPSPVLEFLVRNRLMLAQTWVTHPHPDHEGGAAALWRGYMESPVYGESDIEAATHTVTAGTRFTFGNGQVTVWATPGHTDRHTSYLLETSDGIHVFCGDTLFSAGCGRVFTGTVEQLYDNFQRFNQLPEGTLFYPAHEYTAANLRFAAHIEPDNADIQTALKAAEHTPTLPVTLAHERRVNPFLRTEIPAVRQRAEALVGKTLNSGLEVFAALRELKNAYR

SEQ ID NO: 6635 - DNA, 90 bp, Neisseria gonorrhoeae
gtgtgggatttactctttgcctacactgtgaatattcttgaaaatgcgtgtgttaaaatttgttttttattttcagacggcattttatgt

SEQ ID NO: 6636 - protein, 30 aa, Neisseria gonorrhoeae
VWDLLFAYTVNILENACVKICFLFSDGILC

SEQ ID NO: 6637 - DNA, 366 bp, Neisseria gonorrhoeae
ctcagcagccggtttgtcaaccaattcaaccagtgccagaggtgcattatcacctttacggaatccgtatttcaacactcgaacataaccaccgttacgagcagtaaaacgaggacccaaatcgccaaacagttttactacaacatcacggtcgcgagtacggtcaaatgccaaacggcggcttgccaatgacggctttttacccaatgtaatcaacggctctactacacggcgcaattccttggccttaggcagagttgttacaatagtttcgtgagtcaataatgaattcgccatattacgcagcattgcagcacgatgactgctggtacggtttaatttgcgattgccattacgatgacgcat

SEQ ID NO: 6638 - protein, 63 aa, Neisseria gonorrhoeae
LSSRFVNQFNQCQRCIITFTESVFQHSNITTVTSSKTRTQIAKQFYYNITVASTVKCQTAACQ

SEQ ID NO: 6639 - DNA, 1371 bp, Neisseria gonorrhoeae; identical to SEQ ID NO: 133

SEQ ID NO: 6640 - protein, 457 aa, Neisseria gonorrhoeae; identical to SEQ ID NO: 134

SEQ ID NO: 6641 - DNA, 984 bp, Neisseria gonorrhoeae
aggcttttccaagcctacaggtggccatgcttccaacttagaacccagtgtcaaacctttagatgccaatacttccttaatctcattcaaagatttacgtcccaaattcggcgttttaagaagctcggtttcagtgcgttgaatcaaatcgccaatataataaatatcctcagctttcaaacaattagctgaacgtactgtcaattccagatcatccaccggatgcaaaagaacagggtcgataggaggtgatttttcttcaacctcctccacaggagtaccctgcaaatcagcaaaaatagacatctgatcaatcaaaatacgtgccgcactgcgtacagcttcctcaggatcaatagaaccgtcggtttcgatatccaaaaccaacttatcaagatccgtccgctgctctacacgtgcaggttcaacctcaaagctaacacggctgatgggcgaaaagctcgcatccaactggattgcaccaatctgacggttctcatcacgaactacctgacgacctgaaacagattgataaccacgaccttgctctactttaatttccatttcaatttgaccgttatcagccaaatgacaaatgacatgaccaggattcagaatttctacatcatgcggcaactcaatatcaccggcagatacgacacctgaacctgatttcttcaacacaagttgaacttggctacgaccatggagtttaaacacaatacctttaatattcagcaaaatgtcaacaacatcttcctgaacaccaccaacagtagaatattcgtgcaatacaccggcaatagctacttcagtaggagcaaaaccattcatggatgacagtaagatacggcgcaaagcattacctaaggtatgaccgaaaccacgttcaaatggctgcatagatacttttgcacgagttgcagaaaaagtatttacatcaatttgacgaggtttcaaaaattcggttgtgctattctgcat

SEQ ID NO: 6642 - protein, 63 aa, Neisseria gonorrhoeae
RLFQAYRWPCFQLRTQCQTFRCQYFLNLIQRFTSQIRRFKKLGFSALNQIANIINILSFQTIS

SEQ ID NO: 6643 - DNA, 321 bp, Neisseria gonorrhoeae
ttgccgcaagcagacaccgatccgttttgcggcaaatgcacaaaaaacccaatgccgtctgaaacgccaaacaggcttcagacggcatcggtagcggatgaaaacagcaaatccgcatatcgtcattcctgcgaaaacagctcttcacagccctccggctcccgccatctttaccctgaaatcccgtcattcccgcgaaagtgggaatctaggaatgaaaagcagcaggaatttatcggaaataaccgaaaccgaacggactggattcccgcctgcgcgggaatgacgcggaaaagtgggctgtgggcgggattggtggaa

SEQ ID NO: 6644 - protein, 107 aa, Neisseria gonorrhoeae
LPQADTDPFCGKCTKNPMPSETPNRLQTASVADENSKSAYRHSCENSSSQPSGSRHLYPEIPSFPRKWESRNEKQQEFIGNNRNRTDWIPACAGMTRKSGLWAGLVE

SEQ ID NO: 6645 - DNA, 618 bp, Neisseria gonorrhoeae
tttagagtagaactctaccaccagctgttcattaatatcaccggtcaattcagagcgatccggcatgtttttgaacacaccctcaagtttatctgcatctacagaaacccaacccggcaagccgatttgagttgccaaacccaatgcttcttgaatacgtacctgttttttggctttttcacgaactgagacaacatcaccagctttcacttggaaagaaggaatattgacaacttgtccatttacaactatagccttatgagaaacaagctgtcttgcttcagctcgggtagaaccgaaacccatacgataaacgacattatccaaacgagattccagcaactgcaacagcaactcgccagtagaacctttacggcgatcagcttctgcgaaataacgacggaactgacgttctaatacgccataaatacggcggattttttgtttttcacgcaactgcaaaccatagtctgacaaacgcggtttttttgcaccatgctgaccgggagcggaatcaattttacatttagaatccaaagagcggcgcgcactcttcaaaaacaaatccgtaccttcgcgacgtgccaacttacatttagggccaatataacgtgccat

SEQ ID NO: 6646 - protein, 62 aa, Neisseria gonorrhoeae
FRVELYHQLFINITGQFRAIRHVFEHTLKFICIYRNPTRQADLSCQTQCFLNTYLFFGFFTN

SEQ ID NO: 6647 - DNA, 1071 bp, Neisseria gonorrhoeae; identical to SEQ ID NO: 2499

SEQ ID NO: 6648 - protein, 357 aa, Neisseria gonorrhoeae; identical to SEQ ID NO: 2500

SEQ ID NO: 6649 - DNA, 393 bp, Neisseria gonorrhoeae
aatacgacgttttttaggcggacggcaaccgttatgaggcaacggggtaacgtcagtaatgctggtaatcttgaaaccaagagcattcaaagcacgtacagaggattcgcgacctggacctggacctttaatacgaacctctaaatttttaacgccatactcttgggcaactttaccagctgcttctgctgcaacttgtgctgcaaatggtgtacttttacgagaacctttaaaaccagcgccgccagaggtagcccaagacaacgcattgccttgacggtcagtgattgtaatgatggtattgttgaaagatgcatgaacgtgcacaataccctcactcacggttttacgtacttttttacgtacacgtgaagctgtgtttgctttagccat

SEQ ID NO: 6650 - protein, 47 aa, Neisseria gonorrhoeae
NTTFFRRTATVMRQRGNVSNAGNLETKSIQSTYRGFATWTWTFNTNL

SEQ ID NO: 6651 - DNA, 213 bp, Neisseria gonorrhoeae
atgtccgtgcgccgttcccgtccgtcattcccgcacaggcgggaatccggatttgtccgcacggaaacttatatttcgtcattccaccaatcccgcccacagcccacttttccgcgtcattcccgcgcaggcgggaatccagtccgttcggtttcggttatttccgataaattcctgctgcttttcattcctagattcccactttcgcgggaa

SEQ ID NO: 6652 - protein, 71 aa, Neisseria gonorrhoeae
MSVRRSRPSFPHRRESGFVRTETYISSFHQSRPQPTFPRHSRAGGNPVRSVSVISDKFLLLFIPRFPLSRE

SEQ ID NO: 6653 - DNA, 420 bp, Neisseria gonorrhoeae
gtgggcgggattggtggaatgacgaaatataagtttccgtgcggacaaatccggattcccgcctgtgcgggaatgacggacgggaacggcgcacggacattcgccggaattttttatgtctccattctcatactctttttaatgcgctattccaagaaaataggttgtgcaggctgtttttacttttcagacgacctgaaatcaacggttgtaaatccaatctgtttttcaaaccgcctgcaaccgccaaatctgctgcaacctgccccctcccccgtgggggagggccggggaggcggcattctccaagttgcggcaacctttcccaacaacttaaccgccccaatacaagccttgcggcttgttgccctctctccagccctctcccacggggagagaggacggggaggctgttggggt

SEQ ID NO: 6654 - protein, 140 aa, Neisseria gonorrhoeae
VGGIGGMTKYKFPCGQIRIPACAGMTDGNGARTFAGIFYVSILILFLMRYSKKIGCAGCFYFSDDLKSTVVNPICFSNRLQPPNLLQPAPSPVGEGRGGGILQVAATFPNNLTAPIQALRLVALSPALSHGERGRGGCWG

SEQ ID NO: 6655 - DNA, 108 bp, Neisseria gonorrhoeae
aaatttatttcttaccagcaatcgctttacgcggacctttgcgagtacgcgcatttgtacgagtgcgttgaccgcggcatggtaagccgcgacgatgacggaagccac

SEQ ID NO: 6656 - protein, 36 aa, Neisseria gonorrhoeae
KFISYQQSLYADLCEYAHLYECVDRGMVSRDDDGSH

SEQ ID NO: 6657 - DNA, 816 bp, Neisseria gonorrhoeae
gtgccgcgactttgtcgaagggggtttgacatgaatccgcaggacaaatgctggcaggttcaccgccatcttgccgaacataccgaccaacgcctgacactcgtccgcaacgcgcccgggcatatcctgcttgccggtgcggatgcggacatcagccgcagcctgttggcgaagcgctatccgctggcggtatttgaagaatacgattcccgtgcggattttttggcggctgccgcagccgcgcgcaagggcggtttctggcaaaaactgacgggcaggggcgtggtgcagcactgccaatccccgaccgtgccgctgcccgaagcgtgtgccgatatgttgtggtcgaacctcggactgttggcggcggaacaaatccttcccgtgctgcacaactgggcgcgcgcgctgaagacggacgggctgctgtttttcacctgcttcgggcgcgataccttggcggaactgaaatcccgtctgaaagaaaacggcattgaaagccgcagcgtgatgtttcccgatatgcacgacttgggcgatatgctcgccgaaaacggcttttacgatccagttaccgatacggcgaagctggtgttggactacaaaaaggcggaaacgttttgggcggatatggacacgctgggcgtttggcgggcggtggcgtgggacgacgaaaacgccgcgcgttcgtgtgccggggcgatatttgaacgggaaggcggtttgggcattacgctggaaacggtgtacggacacgccgtgaaaaaactggtgctgccgcagggggagaacgtggtgcgtttttttccgaagaga

SEQ ID NO: 6658 - protein, 272 aa, Neisseria gonorrhoeae
VPRLCRRGFDMNPQDKCWQVHRHLAEHTDQRLTLVRNAPGHILLAGADADISRSLLAKRYPLAVFEEYDSRADFLAAAAAARKGGFWQKLTGRGVVQHCQSPTVPLPEACADMLWSNLGLLAAEQILPVLHNWARALKTDGLLFFTCFGRDTLAELKSRLKENGIESRSVMFPDMHDLGDMLAENGFYDPVTDTAKLVLDYKKAETFWADMDTLGVWRAVAWDDENAARSCAGAIFEREGGLGITLETVYGHAVKKLVLPQGENVVRFFPKR

SEQ ID NO: 6659 - DNA, 393 bp, Neisseria gonorrhoeae
gtgcggacaaatccggattcccgcctgtgcgggaatgacggacgggaacggcgcacggacattcgccggaattttttatgtctccattctcatactctttttaatgcgctattccaagaaaataggttgtgcaggctgtttttacttttcagacgacctgaaatcaacggttgtaaatccaatctgtttttcaaaccgcctgcaaccgccaaatctgctgcaacctgccccctcccccgtgggggagggccggggaggcggcattctccaagttgcggcaacctttcccaacaacttaaccgccccaatacaagccttgcggcttgttgccctctctccagccctctcccacggggagagaggacggggaggctgttggggttaagggttttg

SEQ ID NO: 6660 - protein, 131 aa, Neisseria gonorrhoeae
VRTNPDSRLCGNDGRERRTDIRRNFLCLHSHTLFNALFQENRLCRLFLLFRRPEINGCKSNLFFKPPATAKSAATCPLPRGGGPGRRHSPSCGNLSQQLNRPNTSLAACCPLSSPLPRGERTGRLLGLRVL

SEQ ID NO: 6661 - DNA, 360 bp, Neisseria gonorrhoeae
tttcttaccagcaatcgctttacgcggacctttgcgagtacgcgcatttgtacgagtgcgttgaccgcggcatggtaagccgcgacgatgacggaagccacgatagcagcccatgtccatcaatcgtttgatactcatagttacttcacgacgcaaatcaccttctacttcatacttggcaacttgatcacgcaaagcatctaattgagtctcgtccaaatcttttgctttagtatcaggcgcaatatttgcagcctcacaaatcaatttagcacgagtagcaccaataccgtaaatagcctgaagaccaattacgatgtgtgcgttattagggatatttacccctgcaatacgagccat

SEQ ID NO: 6662 - protein, 25 aa, Neisseria gonorrhoeae
FLTSNRFTRTFASTRICTSALTAAW

SEQ ID NO: 6663 - DNA, 879 bp, Neisseria gonorrhoeae
gtgcggaaacttgccaaatcggtattgcagccggcgcagatgccgtctgaaacgccggacgaaccgtggcataatacgcaacgcctgatagtgggcgcgtctgcgatgcgccgccaacaagagagaaaattcatgcctgatgctgccaaaaaagtttacctgatacacggttggggggcgaaccgccacgcgttcgacgatttgatgccgcgcctgcccgcaacgtggccggtgtccgccgtcgatttgcccggacacggggacgcgcccttcgcgcaacccttcgatattgaggcagctgccgacggcattgccgctcaaatcgatacgtcggccgacattctcggctggtcactcggcggattggtcgcgctgtatctggcggcgcgccatcccgacaaagtccgttcgctctgcctgacggcgagtttcgcacggctgacggctgccgaagactatcccgaagggcttgccgcgcctgcactgggcaaaatggtcggcgcgttccgaacggattatgccaaacatatcaaacagtttctacaactccagcttctgcacacgcctgatgccgccgaaatcatcggcagaatcctgcccgatttggcgcgctgcggcacgcctcaagccttacaggaagctttggacgcggcggaaagggcggatgcgcggcatttgttggacaagatagatgttccggtactgctggtgttcggcggcaaagacgcgattacaccgctgcgtatgggcgagtatctgcatcggcatttgaaaggaagcaggctggttgtgatggaaaaggcggcacacgcgccgtttttgagccatgcggaagcgtttgccgcgctgtgccgcgactttgtcgaagggggtttgaca

SEQ ID NO: 6664 - protein, 293 aa, Neisseria gonorrhoeae
VRKLAKSVLQPAQMPSETPDEPWHNTQRLIVGASAMRRQQERKFMPDAAKKVYLIHGWGANRHAFDDLMPRLPATWPVSAVDLPGHGDAPFAQPFDIEAAADGIAAQIDTSADILGWSLGGLVALYLAARHPDKVRSLCLTASFARLTAAEDYPEGLAAPALGKMVGAFRTDYAKHIKQFLQLQLLHTPDAAEIIGRILPDLARCGTPQALQEALDAAERADARHLLDKIDVPVLLVFGGKDAITPLRMGEYLHRHLKGSRLVVMEKAAHAPFLSHAEAFAALCRDFVEGGLT

SEQ ID NO: 6665 - DNA, 216 bp, Neisseria gonorrhoeae
tcttgctctgaaaacgattcgagccctagttaaatcataaggtgtcagctctactgtgaccttatctcccggagaaatacgaatgtaatgcatccgcatcttcccagaaatatgacccaatacaatatggtcattctcaagttttactttaaatgttgcgttaggtaaagtttcaagaatttcaccttgcatttggatagtatcttctttcgccat

SEQ ID NO: 6666 - protein, 10 aa, Neisseria gonorrhoeae
SCSENDSSPS

SEQ ID NO: 6667 - DNA, 216 bp, Neisseria gonorrhoeae
ttggggcggttaagttgttgggaaaggttgccgcaacttggagaatgccgcctccccggccctcccccacgggggagggggcaggttgcagcagatttggcggttgcaggcggtttgaaaaacagattggatttacaaccgttgatttcaggtcgtctgaaaagtaaaaacagcctgcacaacctattttcttggaatagcgcattaaaaagagta

SEQ ID NO: 6668 - protein, 72 aa, Neisseria gonorrhoeae
LGRLSCWERLPQLGECRLPGPPPRGRGQVAADLAVAGGLKNRLDLQPLISGRLKSKNSLHNLFSWNSALKRV

SEQ ID NO: 6669 - DNA, 606 bp, Neisseria gonorrhoeae
ttggcaagtttccgcaccgacgcggcaaacagctgtcccctgtgtttcaggcacgttcaaggcggcgcggtgtgcggcggatgtcagaaaaaaccgcccgcattcgaccggatgtgggcatcgctgcattacgaaccgcccgtcagcaatatgatacgcgcgctgaagcacttggctgatttgggcatggcgcagccgctggcagacctgacgatgcagaatccgcccgaccggctttcagacgaatgtttcaatttcgtcctacccgttccgctaagcagggagcggctgctgcaacgcgggttcaaccaaagcgagagcatcgtcgggttgttggcgcaacgctacggctggcagatactgccccgacacaccgtattccgacaccaccgcccgccgcaaagcacgctcaaaggcggcgaacggcggcgaaacatcaaaaacgcctttgaaatccgcacaccgataccggaaaactgtaatattttgttaatcgacgatgtctttaccaccggcgcgacgctggacgaattggcaaagacgctgaaaaaatcgggcgcaaaccgaatctgctgctggacgctggcacgcacgccaatgaaaaaa

SEQ ID NO: 6670 - protein, 202 aa, Neisseria gonorrhoeae
LASFRTDAANSCPLCFRHVQGGAVCGGCQKKPPAFDRMWASLHYEPPVSNMIRALKHLADLGMAQPLADLTMQNPPDRLSDECFNFVLPVPLSRERLLQRGFNQSESIVGLLAQRYGWQILPRHTVFRHHRPPQSTLKGGERRRNIKNAFEIRTPIPENCNILLIDDVFTTGATLDELAKTLKKSGANRICCWTLARTPMKK

SEQ ID NO: 6671 - DNA, 138 bp, Neisseria gonorrhoeae
ttgggaaagattgccgcaacttggagaatgccctctccccagccctcccccacgggggaggggcaggttgcagcagatttggcggttgcaggcggtttgaaaaacagattggatttacaaccgttgatgcaggtcgtc

SEQ ID NO: 6672 - protein, 46 aa, Neisseria gonorrhoeae
LGKIAATWRMPSPQPSPTGEGQVAADLAVAGGLKNRLDLQPLMQVV

SEQ ID NO: 6673 - DNA, 255 bp, Neisseria gonorrhoeae
ttgtgcaggctgttttttgcttttcagacgacctgcatcaacggttgtaaatccaatctgtttttcaaaccgcctgcaaccgccaaatctgctgcaacctgcccctcccccgtgggggagggctggggagagggcattctccaagttgcggcaatctttcccaacagcttaaccgccccaatacaagccttgcggcttgttgccctctctccagccctctcccacggggagagaggacggggaggctgttggggt

SEQ ID NO: 6674 - protein, 85 aa, Neisseria gonorrhoeae
LCRLFFAFQTTCINGCKSNLFFKPPATAKSAATCPSPVGEGWGEGILQVAAIFPNSLTAPIQALRLVALSPALSHGERGRGGCWG

SEQ ID NO: 6675 - DNA, 471 bp, Neisseria gonorrhoeae; identical to SEQ ID NO: 2577

SEQ ID NO: 6676 - protein, 157 aa, Neisseria gonorrhoeae; identical to SEQ ID NO: 2578

SEQ ID NO: 6677 - DNA, 1308 bp, Neisseria gonorrhoeae
tttccgagaaaatgatttcatttctgaacgagtcattaacttatcatactgttgagtaagcctatacgaatttatttgtgtactaaaatccatcgttacaacaactagaatcaacaaagacgtgccacccaaataaaaaggtacatttaaaatcgtagttaagaactctggaattaaacaaatagttgtaatataaaaagctccaaacaatgtcaaacgtaatacaactttttctaaatacctagaggtctgctcaccaggtctaatcccaggaacaaaagcaccactcttttttaaattctctgccatttctttaggactaaaaaccaaagccgtataaaaataacaaaagaaaataactgtcgctgcaaataaagccatatacagcaattgaccgtgttgtaacaatccagctattttgtgcaaaacactatttgtatcagccgaaccaaaccaacctaaaagagtagatggaaatagaataatactggaagcaaaaattgggggaataacaccagccatattcaacttgaaaggcatatgcgtactttgactacccgccctaccattaaactggcgttttgcataatgaataggaatcttccgctgtgcactttcaaagtatacaaccaaataaattaataataaggcaccaaatacaataagcaacgccgtaagcatgctcatagaaccttggttcgtcagtgtaaccagctttgcaatacccgaaggaatacctgaagcaatacctgccgtaatgattaaagaaataccgttcccgatacccctttcagtaatttgctccccaagccacataagaaacatggttcccgttaccaaagaaactaccgtggaaacatgaaactcaaatgaacttgttacaacaattccttgctgaaatacgaaagatgcaacacctagactttgaagaattgctaacaaaacagtaccatacctagtatatttcgtaattacctttctaccagcctccccttctttttttaaagccttcaatgatggcaaaatttcagaagcgagctgtacaataatagaagctgaaatatatggcataattcctattgcaaatatactaaagcgctctaacgacccaccggaaaacatattcaatattcccaggatgccgtttccagcgctttcgtataatttagctaaagcaacagcatcaaccccaggtacgggtatatgggcaccaattcgaaaaacaatcaatgctccaaatagaaacaaaagacgtttcttaagatctccaaacttggatgaacctgatgacgtttgttgattagccac

SEQ ID NO: 6678 - protein, 4 aa, Neisseria gonorrhoeae
FPRK

SEQ ID NO: 6679 - DNA, 177 bp, Neisseria gonorrhoeae
aagatttaaaacctcttttagggaggcgtcgttgcaagggcatttgaccaccctcgaaacccaccttatgaaacccaccagaccggctcttttgacctttatgaccacgaccacccgttttgccaagaccactaccaataccgcgtccaacacgacgaccagcatgcgtagcaccaa

SEQ ID NO: 6680 - protein, 49 aa, Neisseria gonorrhoeae
GGVVARAFDHPRNPPYETHQTGSFDLYDHDHPFCQDHYQYRVQHDDQHA

SEQ ID NO: 6681 - DNA, 141 bp, Neisseria gonorrhoeae
ttgttgggaaaggttgccgcaacttggagaatgccctctccccggccctccccacgggggagggggcggattgcggcaggttttgcggttgcaggcggtttgaaaaacagattggatttacaaccgttgatgcaggtcgtc

SEQ ID NO: 6682 - protein, 47 aa, Neisseria gonorrhoeae
LLGKVAATWRMPSPRPSPRGRGRIAAGFAVAGGLKNRLDLQPLMQVV

SEQ ID NO: 6683 - DNA, 732 bp, Neisseria gonorrhoeae; identical to SEQ ID NO: 3661

SEQ ID NO: 6684 - protein, 244 aa, Neisseria gonorrhoeae; identical to SEQ ID NO: 3662

SEQ ID NO: 6685 - DNA, 624 bp, Neisseria gonorrhoeae
atgtatgcaggcgaacgcttcaatacttacagccatttgagcggtttgattctggcggcggcaggtttgatgctgatgctgctgaaaaccataggacacggggacggctaccgtatcttcagcgtatcggtttacggcatcagccttcttctgctctatttgagttcctcgctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccatcggacggaaaagcgaaaaacgtctgctgtctattgcgatttatatcgtaatgggctggatggtcttggcggtaatgaaatccctgacagcctcactcccgccggcaggactggcttggctggcggcaggcggtatgctgtacagcgtcggcatttactggtttgtaaacgatgaaaaaatccgacacgggcacggaatctggcatctgttcgtattgggcggcagcataacccaatttgtcagcgtgtacggttatgtaatc

SEQ ID NO: 6686 - protein, 208 aa, Neisseria gonorrhoeae
MYAGERFNTYSHLSGLILAAAGLMLMLLKTIGHGDGYRIFSVSVYGISLLLLYLSSSLYHGIAAGKLKSILKKTDHCMIYVLIAGSYTPFALVSLRNGPGWTVFSLSWLLAAAGIAQELTIGRKSEKRLLSIAIYIVMGWMVLAVMKSLTASLPPAGLAWLAAGGMLYSVGIYWFVNDEKIRHGHGIWHLFVLGGSITQFVSVYGYVI

SEQ ID NO: 6687 - DNA, 852 bp, Neisseria gonorrhoeae
ttgctagggttccgctgtatattaacgcctttcggatacacctttcagacggcatccgaaccatcaaggaacactcatgaaaattacccccgtcaaagccctgaccgacaactacatctggatgatacagcacggcaaccatgccgtctgcgtcgatccttccgaaccctcgcccgtcttggaattcctcgtacgcaaccgactcatgctcgcccaaacctgggtaacgcacccccatcccgaccacgaaggcggtgcggcggcactctggcgcggctacatggaatcgcccgtttacggcgaatccgacatcgaagccgccacccacaccgtaaccgccggcacacgattcaccttcggcaacggtcaggttaccgtttgggcaacacccggccacacagaccgccacaccagctaccttctcgaaacttcagacggcatacacgttttctgcggcgacacccttttttccgccggctgcggacgcgtgtttaccggcacggtcgaacagctttacgacaacttccaacggttcaaccaattacccgaaggcaccctgttctatccggcacacgaatacaccgccgccaacctgcgtttcgccgcccatatcgagccggacaacgccgacattcagacggcattgaaggcggcggaacacacgcccaccctgcccgttaccctcgcgcacgaacgccgcgtcaacccgttcttacggacagaaatccccgccgtccgccaacgtgccgaagccctggtcggcaaaacgctgaacagcggtttggaagtattcgccgccctgcgcgaactgaaaaacgcctaccgctgacctgccctccgaaaaatgccgtc

SEQ ID NO: 6688 - protein, 284 aa, Neisseria gonorrhoeae
LLGFRCILTPFGYTFQTASEPSRNTHENYPRQSPDRQLHLDDTARQPCRLRRSFRTLARLGIPRTQPTHARPNLGNAPPSRPRRRCGGTLARLHGIARLRRIRHRSRHPHRNRRHTIHLRQRSGYRLGNTRPHRPPHQLPSRNFRRHTRFLRRHPFFRRLRTRVYRHGRTALRQLPTVQPITRRHPVLSGTRIHRRQPAFRRPYRAGQRRHSDGIEGGGTHAHPARYPRARTPRQPVLTDRNPRRPPTCRSPGRQNAEQRFGSIRRPARTEKRLPLTCPPKNAV

SEQ ID NO: 6689 - DNA, 177 bp, Neisseria gonorrhoeae
ttgtgcaggctgttttttgcttttcagacgacctgcatcaacggttgtaaatccaatctgtttttcaaaccgcctgcaaccgcaaaacctgccgcaatccgccccctcccccgtggggagggccggggagagggcattctccaagttgcggcaacctttcccaacaactcaaccgcc

SEQ ID NO: 6690 - protein, 59 aa, Neisseria gonorrhoeae
LCRLFFAFQTTCINGCKSNLFFKPPATAKPAAIRPLPRGEGRGEGILQVAATFPNNSTA

SEQ ID NO: 6691 - DNA, 684 bp, Neisseria gonorrhoeae; identical to SEQ ID NO: 2631

SEQ ID NO: 6692 - protein, 228 aa, Neisseria gonorrhoeae; identical to SEQ ID NO: 2632

SEQ ID NO: 6693 - DNA, 432 bp, Neisseria gonorrhoeae
catttcaatcttaccaccaacatcctcgatagcagctctcgcacctttggtaactttaatacccttcaaagcaactgccttagaaatttcaccagaagcaataactttaacattagagactgtagatgcaatcagacctgcttgctttaagactaaaatatcaatctcattaacagcaattgattccagttcacttaaacgaagctgtgcattagctgatactgttaaagatttaaaacctcttttagggaggcgtcgttgcaagggcatttgaccaccctcgaaacccaccttatgaaacccaccagaccggctcttttgacctttatgaccacgaccacccgttttgccaagaccactaccaataccgcgtccaacacgacgaccagcatgcgtagcaccaacagcaggttgaattgtattcaaaaacat

SEQ ID NO: 6694 - protein, 49 aa, Neisseria gonorrhoeae
HFNLTTNILDSSSRTFGNFNTLQSNCLRNFTRSNNFNIRDCRCNQTCLL

SEQ ID NO: 6695 - DNA, 183 bp, Neisseria gonorrhoeae
agactccactttcaacaagtagctgattttattaatcataccacggttttcagaggtatctaaaacctctaccgtatgctcgcgacgacgcaaacctaaaccgcgtgcacatgcacgatgagattcaattgtaccaatcaggcttttaaccaatgtaaccctaatctttttttgttcagccat

SEQ ID NO: 6696 - protein, 20 aa, Neisseria gonorrhoeae
RLHFQQVADFINHTTVFRGI

SEQ ID NO: 6697 - DNA, 150 bp, Neisseria gonorrhoeae
ttgtcgaaattcggggagccctctcccccacgggggagggggcaggttgcggcagatttggcggttgcaggcggtttgaaaaacagattggatttacaaccgttgatttcaggtcgtctgaaaagcaaaaagcagcctgcacaacctgat

SEQ ID NO: 6698 - protein, 50 aa, Neisseria gonorrhoeae
LSKFGEPSPPRGRGQVAADLAVAGGLKNRLDLQPLISGRLKSKKQPAQPD

SEQ ID NO: 6699 - DNA, 324 bp, Neisseria gonorrhoeae; identical to SEQ ID NO: 2669

SEQ ID NO: 6700 - protein, 108 aa, Neisseria gonorrhoeae; identical to SEQ ID NO: 2670

SEQ ID NO: 6701 - DNA, 516 bp, Neisseria gonorrhoeae
gccatggttaactcccaaaatgtcttccactgtcaagccacgtttggctgcgatatcagcaggagtatgcaacttagacaaaccatctaatgttgcacgtacgatattatatgggttagtagatccgtgcactttggcggaaatattatgaatgcccatagcatcaaaaaccaaacgcataggtccaccggcttttacgccactaccctctttagcaggctgcataaatactttagtagcaccatgtcgaccaataacctcatgatggatcgtaccattttttaatggtaccttaatcatagagcgtcgtgcttgatccatcgccttttggactgcaacaggcacttcttttgacttacctttacccataccaatacgaccatctccatcaccaacaacagttagcgcagagaaagccataatgcgaccacctttaactactttggttacacggttaactgcgaccatcttttcaatcagaccgtcaccgcgttcttcaatttcatgttttgccat

SEQ ID NO: 6702 - protein, 29 aa, Neisseria gonorrhoeae
AMVNSQNVFHCQATFGCDISRSMQLRQTI

SEQ ID NO: 6703 - DNA, 120 bp, Neisseria gonorrhoeae
ttgccgccggcctccaccaatcccttcaatattaccgatcccgccattgccgccgattccgtcaaatccatcaattccgccgaatcacgcctattccccaaaaaccttgatgcggcgggc

SEQ ID NO: 6704 - protein, 40 aa, Neisseria gonorrhoeae
LPPASTNPFNITDPAIAADSVKSINSAESRLFPKNLDAAG

SEQ ID NO: 6705 - DNA, 351 bp, Neisseria gonorrhoeae
gaagcttaaaccattttcacgagcagcttcagccaaagccttcacacgaccgtgatattggaaacctgaacgatcaaaagcaaccttttctacacctgctgctttagccttctcagcaatacgtttaccaactattgcagctgcttcaacattgcttccagatttcagactaccgcgcacctcagcttccaatgtagaggcttgagccaatactttatcaccttcagcactaattacttgagcataaatatgattattgcttcggaacacacataatcttaccattttcaagtccgcaatacgagcacgggttttgcgtgcacgacggagtcgggttgtatgtttatccat

SEQ ID NO: 6706 - protein, 19 aa, Neisseria gonorrhoeae
TIFTSSFSQSLHTTVILET

SEQ ID NO: 6707 - DNA, 543 bp, Neisseria gonorrhoeae
ttgatgcggcgggctgaagcccgccctgcaaccctctctatgcacccccttgcgagcccgacactacgcaacatcttgagaacccatcctgtcaagaatacccgaaccgtcccgatacaccgtaatcctaaaacccgccattcccgcgcaggcgggaatccagtccgttcggtttcagtcatttccaaaaattgccgtagcgttaagtttctagattcccactttcggaggaatgacgcggtgcaggtttccgtgcggacggattcgtcattcccacacagacaggaatccggatttgtccgcgcggaaacttatgcgccgtcattcccgcacaggcgggaattcaggtctgtcggcataggaacttatcggataaaacggttgccccaaccctgcgttctagattcccactttcgtgggaatgacgattcaggtattcctaatagcaacccgccacaacccacctacgcccatcctacgcatctgccatacagccctgttccggagcgcgcggataaggtgcgatgccgccggcgggcatca

SEQ ID NO: 6708 - protein, 181 aa, Neisseria gonorrhoeae
LMRRAEARPATLSMHPLASPTLRNILRTHPVKNTRTVPIHRNPKTRHSRAGGNPVRSVSVISKNCRSVKFLDSHFRRNDAVQVSVRTDSSFPHRQESGFVRAETYAPSFPHRREFRSVGIGTYRIKRLPQPCVLDSHFRGNDDSGIPNSNPPQPTYAHPTHLPYSPVPERADKVRCRRRAS

SEQ ID NO: 6709 - DNA, 612 bp, Neisseria gonorrhoeae; identical to SEQ ID NO: 2695

SEQ ID NO: 6710 - protein, 204 aa, Neisseria gonorrhoeae; identical to SEQ ID NO: 2696

SEQ ID NO: 6711 - DNA, 531 bp, Neisseria gonorrhoeae
ttttttcttggcttctttcattaccactacttcgcctacatagcgaacacctttacctttataaggctcaggagcacggaacgcacgaatctcagaagcaacttgaccaacaacttgtttatccgagccagttaaaacaatctctgtttggctaggagtttgaacggagacaccttcaggcatttcatatacgatcggatgagaaaaacccaaagacagattcaagattttaccttgtgcttgagcacgataacccacgcccatcaattgtaatttcttctcaaaaccttctgaaacacctttaaccatattgctgactaatgcgcgagcagtaccagacattgcatttgcttgtttactgctattattcgcaacaaaagtcaatttgccatcattaaattcaatggctacatcagaatgcaaaggaaaagacaattcaccgttcttacccttaataaccaatgcctctgttccaaattttacttctacaccagcgggaaccgtcactgggttttttgcgacacgtgacat

SEQ ID NO: 6712 - protein, 44 aa, Neisseria gonorrhoeae
FFLGFFHYHYFAYIANTFTFIRLRSTERTNLRSNLTNNLFIRAS

SEQ ID NO: 6713 - DNA, 297 bp, Neisseria gonorrhoeae
gtgcaggcggatctggcttacgcctacgagcacatcacccgcgattatcccgaagcaaccggtgcaaaaaaaggcacaacaataagcacggtaagcgattatttcaaaaacatccgcacccgctccgtccacccccgactcgccctcggctacgatttcggcggctggcgcgtcttttccgcccccgccgttgccgccggcctccaccaatcccttcaatattaccgatcccgccattgccgccgattccgtcaaatccatcaattccgccgaatcacgcctattccccaaaaacct

SEQ ID NO: 6714 - protein, 99 aa, Neisseria gonorrhoeae
VQADLAYAYEHITRDYPEATGAKKGTTISTVSDYFKNIRTRSVHPRLALGYDFGGWRVFSAPAVAAGLHQSLQYYRSRHCRRFRQIHQFRRITPIPQKP

SEQ ID NO: 6715 - DNA, 177 bp, Neisseria gonorrhoeae
atgttcggattatactgtcagttatgccgtctgaaaatgccgtttgcccgatcttgcgccttaaaaatgccgtctgaaggttcagacggcatcggaatcggcgaatcagaaaaaatgccgtctgaaggttcagacggcatcggaatcggcgaatcagaagcggtagcgcacgcccaa

SEQ ID NO: 6716 - protein, 59 aa, Neisseria gonorrhoeae
MFGLYCQLCRLKMPFARSCALKMPSEGSDGIGIGESEKMPSEGSDGIGIGESEAVAHAQ

SEQ ID NO: 6717 - DNA, 135 bp, Neisseria gonorrhoeae; identical to SEQ ID NO: 2709

SEQ ID NO: 6718 - protein, 45 aa, Neisseria gonorrhoeae; identical to SEQ ID NO: 2710

SEQ ID NO: 6719 - DNA, 390 bp, Neisseria gonorrhoeae
ggctacaatgcataacaactcaccaccaacaccttgagaacgtgctttacgatcagtcattacacctttagaagtactaacgatagcaatacccaagccattcataacacttggaatctcactagacgctttataaatacgcaaaccggggcgagatacacgcttgatttgttcaattacaggacgacctgcatagtattttaattgaatttccaatatagactttacgtcagatgaaactgcgaagtcctcaatatatccttcttctttcaatacctttgcaatagcacactttaattttgaagaaggcattgcaactgctgctttattagcacgttgcgcattgcggatacgagtcaacatatcggaaataggatcatgcatactcat

SEQ ID NO: 6720 - protein, 4 aa, Neisseria gonorrhoeae
GYNA

SEQ ID NO: 6721 - DNA, 303 bp, Neisseria gonorrhoeae
ccagctggctttaacaacacccggaatttcgccacgcatggcgatttcacggattttaatacgacccaaaccaaatttacggaaagtaccacgagggcgacctgtcaaagcacaacgacgacgttgacgcacaggtgccgcattacgaggaatggattgaaacctcaaacgagcctcaaaacgctcttcctcagttgcattcgaatcattgattaccgctttaattgccgcgcgtttagccgcatattttttagccaaagcttgacgtttcagatcacgattaataagtgctttcttagccat

SEQ ID NO: 6722 - protein, 101 aa, Neisseria gonorrhoeae
PAGFNNTRNFATHGDFTDFNTTQTKFTESTTRATCQSTTTTLTHRCRITRNGLKPQTSLKTLFLSCIRIIDYRFNCRAFSRIFFSQSLTFQITINKCFLSH

SEQ ID NO: 6723 - DNA, 537 bp, Neisseria gonorrhoeae
tcctttgaacggaaatttaaacaatgacaataaagctttcgcttcctcatcggtttttgctgtagtagtaatagtaatattcaaaccacgcaaagcatcaattttatcgtattcaatttccgggaaaataatttgctcacgaacacccatattgtaattgccacgaccatcaaatgatttaccgctcacaccacggaagtcacgtacgcgaggtaatgcaatagtaatcaaacgatccaagaattcaaacatttgatcacgacgcaatgttactttgcaaccaaccggatagttatcacggattttaaaacctgcgatagatttacgggcaacagtaacaaccggtctttgaccggcaattctctctaaatcggaaacagcatgttccataacttttttgtcagcaacagcctcacccacacccatattcaaggtgattttttcaatacgcgggacttccattactgatttgtaaccaaattgtttaaccaattcaggaacaactgtctctttataaaactctctcaaccgagccat

SEQ ID NO: 6724 - protein, 8 aa, Neisseria gonorrhoeae
SFERKFKQ

SEQ ID NO: 6725 - DNA, 834 bp, Neisseria gonorrhoeae
ttgatatgcatacggtcgacaaaaaacttctcttctcttctcttctcttctcttctcttctcttctcttctcttctcttccgcagcgcgggcggcgggtgaagaccatgggcgcggcccgtatgtgcaggcggatctggcttacgcctacgagcacattacccgcgattatcccgatgcagccggtgcaaacaaaggcaaaataagcacggtaagcgattatttcagaaacatccgtacgcattccatccaccccagggtgtcggtcggctacgacttcggcggctggcgcatcgccgcggattatgcccgttacaggaaatggcacaacaataaatattccgtgaacataaaagagttggaaagaaagaataataaaacttttggcggcaaccagcttaacataaaataccaaaagacggaacatcaggaaaacggcacattccacgccgtttcttctctcggcttgtcaaccgtttacgatttcagagtcaacgataaattcaaaccctatatcggtgtgcgtgtcggctacggacacgtcagacacggtatcgattcgactaaaaaaacgaaaaatactcttaccgcctaccatagtgctggcacaaaacctacgtattatgatgatatagattcgggaaaaaaccaaaaaaacacttatcgccaaaaccgcagcagccgccgcttgggcttcggcgcgatggcgggcgtgggcatagacgtcgcgcccggcctgaccttggacgccggctaccgctaccactattggggacgcctggaaaacacccgcttcaaaacccacgaagcctcattgggcgtgcgctaccgcttc

SEQ ID NO: 6726 - protein, 278 aa, Neisseria gonorrhoeae
LICIRSTKNFSSLLFSSLLFSSLLFSSAARAAGEDHGRGPYVQADLAYAYEHITRDYPDAAGANKGKISTVSDYFRNIRTHSIHPRVSVGYDFGGWRIAADYARYRKWHNNKYSVNIKELERKNNKTFGGNQLNIKYQKTEHQENGTFHAVSSLGLSTVYDFRVNDKFKPYIGVRVGYGHVRHGIDSTKKTKNTLTAYHSAGTKPTYYDDIDSGKNQKNTYRQNRSSRRLGFGAMAGVGIDVAPGLTLDAGYRYHYWGRLENTRFKTHEASLGVRYRF

SEQ ID NO: 6727 - DNA, 1854 bp, Neisseria gonorrhoeae; identical to SEQ ID NO: 2757

SEQ ID NO: 6728 - protein, 618 aa, Neisseria gonorrhoeae; identical to SEQ ID NO: 2758

SEQ ID NO: 6729 - DNA, 321 bp, Neisseria gonorrhoeae
tgctccaatgatagagccatttgatttgaagaaacgaacgcgtttaactttgccttcattttcaatcagcttaataccaacacggtccgctttattagtttccggattcaggattgcgatattagaaatatccaaaggcatttctttagtaataataccgcccttaatgccacgcattggattaggtttttgatggcgttttacaacattaacgccctcaacaacaactttaccacccaacactcgaactacttgaccctgcttacctttatccttaccagcaattactacaaccctatcgcctttaatgattttattcat

SEQ ID NO: 6730 - protein, 7 aa, Neisseria gonorrhoeae
CSNDRAI

SEQ ID NO: 6731 - DNA, 96 bp, Neisseria gonorrhoeae
gtgctgtttccaaccctgcgcctgtaccgtcaggcttttattatggaccttcccagttcgtttttactgaacaccccttccgattccaaacgacaa

SEQ ID NO: 6732 - protein, 32 aa, Neisseria gonorrhoeae
VLFPTLRLYRQAFIMDLPSSFLLNTPSDSKRQ

SEQ ID NO: 6733 - DNA, 417 bp, Neisseria gonorrhoeae
ttgatggcgttttacaacattaacgccctcaacaacaactttaccacccaacactcgaactacttgaccctgcttacctttatccttaccagcaattactacaaccctatcgcctttaatgattttattcatcgtgctattccttataatacttcaggtgccaatgaaacgattttcataaatcgctcagtacgcaattcacgggttaccggaccaaagatacgagtacccaaaggttcaagtttattattcagcaacacggcggcattgttatcgaatttaattaacgcaccatcaggacgacgcacacccttagcagtacgaacaactaccgcattatatacatcgccttttttgacacggccacgcggaaccgcatctttaactgccactttaataatatcgccaacagaagcg

SEQ ID NO: 6734 - protein, 139 aa, Neisseria gonorrhoeae
LMAFYNINALNNNFTTQHSNYLTLLTFILTSNYYNPIAFNDFIHRAIPYNTSGANETIFINRSVRNSRVTGPKIRVPKGSSLLFSNTAALLSNLINAPSGRRTPLAVRTTTALYTSPFLTRPRGTASLTATLIISPTEA

SEQ ID NO: 6735 - DNA, 180 bp, Neisseria gonorrhoeae
ttgttttgccgggatatgattttttttgttaaagaatgtatttattttttaaaattccggtgcggcgatcggatatggcggattaacaaaaatcaggacaaggcggcgaagccgcagacagtacaaatagtacggaaccgattcacttggtgcttcagcaccttagagaatcgttctctt

SEQ ID NO: 6736 - protein, 60 aa, Neisseria gonorrhoeae
LFCRDMIFFVKECIYFLKFRCGDRIWRINKNQDKAAKPQTVQIVRNRFTWCFSTLENRSL

SEQ ID NO: 6737 - DNA, 921 bp, Neisseria gonorrhoeae; identical to SEQ ID NO: 2791

SEQ ID NO: 6738 - protein, 307 aa, Neisseria gonorrhoeae; identical to SEQ ID NO: 2792

SEQ ID NO: 6739 - DNA, 366 bp, Neisseria gonorrhoeae
taatacttcaggtgccaatgaaacgattttcataaatcgctcagtacgcaattcacgggttaccggaccaaagatacgagtacccaaaggttcaagtttattattcagcaacacggcggcattgttatcgaatttaattaacgcaccatcaggacgacgcacacccttagcagtacgaacaactaccgcattatatacatcgccttttttgacacggccacgcggaaccgcatctttaactgccactttaataatatcgccaacagaagcgtagcgacgcttagatccgcccaataccttgatacacattacgcgacgcgcaccagagttatcagccacatctaagatggtctgcatttgaatcat

SEQ ID NO: 6740 - protein, 5 aa, Neisseria gonorrhoeae
YFRCQ

SEQ ID NO: 6741 - DNA, 189 bp, Neisseria gonorrhoeae
gtgtcatcattcccgatacaccgtaatcctgaaacccgtcattcccgcgcagacagaaatccggatttgtccgcgcggaaacttatgcgccgccattcccgcgaaggcgggaatccggaccgttcggtttcggttatttccgataaattcctgctgcttttcattcctagattcccactttcgcgggaa

SEQ ID NO: 6742 - protein, 63 aa, Neisseria gonorrhoeae
VSSFPIHRNPETRHSRADRNPDLSARKLMRRHSREGGNPDRSVSVISDKFLLLFIPRFPLSRE

SEQ ID NO: 6743 - DNA, 330 bp, Neisseria gonorrhoeae; identical to SEQ ID NO: 2809

SEQ ID NO: 6744 - protein, 110 aa, Neisseria gonorrhoeae; identical to SEQ ID NO: 2810

SEQ ID NO: 6745 - DNA, 261 bp, Neisseria gonorrhoeae
aatagaacgtgctttctcaaccaactcactgacaacccaagatttagtttttgacaatggacgggattccgatataacaaccacatcaccaattccatattgattattttcatcatgggcatggattttagtagataatcgaataatcttaccatacagcgaatgttttactttacgctcaaccaatactgttacggttttatccattttgtcgcttactactttgccttgcaaagtacgaacatttttagtttcgctcat

SEQ ID NO: 6746 - protein, 17 aa, Neisseria gonorrhoeae
NRTCFLNQLTDNPRFSF

SEQ ID NO: 6747 - DNA, 411 bp, Neisseria gonorrhoeae
atgccgtctgaagggttttcagacggcatttttgcgctatttaccgtaatcctgaaatcccgtcattcccacgcaggcaggaatctagatgagaatccatcctgtcagaaatacccgaatcgtcaggaatacccgtgtcatcattcccgatacaccgtaatcctgaaacccgtcattcccgcgcagacagaaatccggatttgtccgcgcggaaacttatgcgccgccattcccgcgaaggcgggaatccggaccgttcggtttcggttatttccgataaattcctgctgcttttcattcctagattcccactttcgcgggaatgacgaaggagtgggaatccggtttttgagttccggccatttccgacaaattgctttggcattggatatttcctattttaatccacta

SEQ ID NO: 6748 - protein, 137 aa, Neisseria gonorrhoeae
MPSEGFSDGIFALFTVILKSRHSHAGRNLDENPSCQKYPNRQEYPCHHSRYTVILKPVIPAQTEIRICPRGNLCAAIPAKAGIRTVRFRLFPINSCCFSFLDSHFRGNDEGVGIRFLSSGHFRQIALALDISYFNPL

SEQ ID NO: 6749 - DNA, 894 bp, Neisseria gonorrhoeae; identical to SEQ ID NO: 2849

SEQ ID NO: 6750 - protein, 298 aa, Neisseria gonorrhoeae; identical to SEQ ID NO: 2850

SEQ ID NO: 6751 - DNA, 189 bp, Neisseria gonorrhoeae
cttagcacctttttcagttaaaacggttttaatacgagcaatatcgcgacgtacacgtttcaattcacttggtttgcctaattgaccggtagcgttttgcatacgtaagccaaactgagctttcaacaagtccaacaaatctgcattcaactgctcaacggatttgtctttcaattcatttgctttcat

SEQ ID NO: 6752 - protein, 6 aa, Neisseria gonorrhoeae
LSTFFS

SEQ ID NO: 6753 - DNA, 1578 bp, Neisseria gonorrhoeae
atgtccgtcatcaaacgcgccctgatcagcctgtccgacaaggcaggcgcggtcgaatttgcccaaaacctgcacaagctcggtgtcgaaatcctctccaccggcggcacggcgaaactgcttgccggtgcgggcgttcccgtgattgaagtcgccgactacaccggttttcccgaaatgctcgacggccgcgtgaaaaccctgcatccgaaaatccacggcggtattttgggccggcgcgatttggacgaacacgtcgccaagatggaagagcacggcatcggcaacatcgaccttgtgtgtgtcaatctttaccccttcgccgccaccatcgccaagcccggctgcacactggaagacgcgattgaaaacatcgacatcggcggcccgactatggtgcgctccgccgcgaaaaactggaaacacgtcgccatcgttaccgacaccgccgacttccccgccattgccgccgaactcgaagccaacaacggcgcgttgagcgataaaacccgcttcaacctctcacgcaaagcattcagccacaccgcccaatacgacggcatgatttccaactatttaacctcgctttcagacggtgttttgagcggagagcctgaaatcggcgaattcccaagccggttcaaccaaagctggattaaagtgcaagacatgcgctacggcgaaaacccgcatcagcgcgccgcgttttaccgcgatattgaccccgccgcaggcagcctttccgcctacaatcaactgcaaggcaaagaattgtcttacaacaacatcgccgatgccgatgccgcttgggaagccgtcaaatcctttgacgcgcccgcctgcgtgatcgtgaaacacgccaatccgtgcggcgtagccgttgcagccgataccttgaccgcctacaaactcgcctacgccaccgacaccaccagcgcgttcggcggcatcatcgccttcaaccgcgaagtcgacggcgaaaccgtcaaacagattaccgacaaccaatttatggaagtcctcatggcgccgaagtttaccgccgaagcccttgaaatcgccgccgccaagaaaaacgtgcgcgtattggaagtgccgctcaaagcaggtgccaaccgctttgaactcaaacgcgtcggcggcggactgttggtacaaacgcccgacatcaaccgcatcaaccgcgccgatttgaaagtcgtctccaaacgccaaccgaccgagcaggaatggaacgatttgctgtttgtctggaacgtcgcaaaatacgtcaaatccaacgccatcgtcttcggcaaaggcggccaaacctacggtatcggcgcaggccaaatgagccgcgtggacagcacccgcatcgccgcccgcaaagcgcaagatgccggtctcgacctcaacggcgcatgtgccgcttccgatgccttcttcccattccgcgacggcgtggacgtgattgccgaacagggcatcaaagccatcatccatccggcaggctcgatgcgcgatcaggaagttttcgacgcggcggacgaacacggcatcgccatggcggtaaccggcatccgccacttccgccat

SEQ ID NO: 6754 - protein, 526 aa, Neisseria gonorrhoeae
MSVIKRALISLSDKAGAVEFAQNLHKLGVEILSTGGTAKLLAGAGVPVIEVADYTGFPEMLDGRVKTLHPKIHGGILGRRDLDEHVAKMEEHGIGNIDLVCVNLYPFAATIAKPGCTLEDAIENIDIGGPTMVRSAAKNWKHVAIVTDTADFPAIAAELEANNGALSDKTRFNLSRKAFSHTAQYDGMISNYLTSLSDGVLSGEPEIGEFPSRFNQSWIKVQDMRYGENPHQRAAFYRDIDPAAGSLSAYNQLQGKELSYNNIADADAAWEAVKSFDAPACVIVKHANPCGVAVAADTLTAYKLAYATDTTSAFGGIIAFNREVDGETVKQITDNQFMEVLMAPKFTAEALEIAAAKKNVRVLEVPLKAGANRFELKRVGGGLLVQTPDINRINRADLKVVSKRQPTEQEWNDLLFVWNVAKYVKSNAIVFGKGGQTYGIGAGQMSRVDSTRIAARKAQDAGLDLNGACAASDAFFPFRDGVDVIAEQGIKAIIHPAGSMRDQEVFDAADEHGIAMAVTGIRHFRH

SEQ ID NO: 6755 - DNA, 477 bp, Neisseria gonorrhoeae
ttgctttcattattgacccacctgtcttactacaaaggttgtaggaataggcaatttggcagcagccaactcgaatgcttcacgagccagttcctctggaacgccatccatttcatacaacactttacctggtttaatttcggcaatgtaatattccacgttacctttaccgccacccatacgaacttgaataggcttttcagtaatcggtttgtcagggaatacacgaatccaaatacgaccaccacgtttgatgtgacgggtcattgcacgacgagcagcttcgatttgacgggcagtcaaacgaccacgacctacggctttcaagccgaactcaccgaaacttaccttattaccgcgagtagcgatgccggtattgcgacccttttgttgcttacggtatttcagtctagttggctgcagcattacgtctacctgcctttctttgtttactctcatgttcaggtttggaagatt

SEQ ID NO: 6756 - protein, 159 aa, Neisseria gonorrhoeae
LLSLLTHLSYYKGCRNRQFGSSQLECFTSQFLWNAIHFIQHFTWFNFGNVIFHVTFTATHTNLNRLFSNRFVREYTNPNTTTTFDVTGHCTTSSFDLTGSQTTTTYGFQAELTETYLITASSDAGIATLLLLTVFQSSWLQHYVYLPFFVYSHVQVWKI

SEQ ID NO: 6757 - DNA, 414 bp, Neisseria gonorrhoeae
ttgacccacctgtcttactacaaaggttgtaggaataggcaatttggcagcagccaactcgaatgcttcacgagccagttcctctggaacgccatccatttcatacaacactttacctggtttaatttcggcaatgtaatattccacgttacctttaccgccacccatacgaacttgaataggcttttcagtaatcggtttgtcagggaatacacgaatccaaatacgaccaccacgtttgatgtgacgggtcattgcacgacgagcagcttcgatttgacgggcagtcaaacgaccacgacctacggctttcaagccgaactcaccgaaacttaccttattaccgcgagtagcgatgccggtattgcgacccttttgttgcttacggtatttcagtctagttggctgcagcat

SEQ ID NO: 6758 - protein, 138 aa, Neisseria gonorrhoeae
LTHLSYYKGCRNRQFGSSQLECFTSQFLWNAIHFIQHFTWFNFGNVIFHVTFTATHTNLNRLFSNRFVREYTNPNTTTTFDVTGHCTTSSFDLTGSQTTTTYGFQAELTETYLITASSDAGIATLLLLTVFQSSWLQH

SEQ ID NO: 6759 - DNA, 1140 bp, Neisseria gonorrhoeae
atgcacttcatacggcatacggcatacggttatgacgcggacggtgcgtacatctcgttccgcgaaggtgtggcacaggctttcggtatgcggcgcgttgccatgctgacgctgtgcggcgcgatcgcaggcggcggctggtggctgctcaaacgtttcggcaagccgcaaatcgaaatcaaagccgccttgaagcagccgttgcaggggctgccgtttctgacgacggttttccatgttctgctgcaaatcataacggtcggactcggttcgccgctcggacgcgaagtcgccccgcgtgaaatgactgccgcgtttgcttttgccggcggcaggcggttgggtttggacgaaggcgaaatgcgcctcttgattgcctgtgcgtccggagcgggtttggcggcggtgtataacgtgccgctcgcctccacgctgtttatcctcgaagcgatgttgggcgtgtggacgcagcaggcggttgccgccgcattgctgacttccgtcatcgccaccgccgtcgcgcgcatcggcttaggcgacgtgcagcagtatcatcccgccaaccttgccgtaaatacttcattgctttggttttccgccgtcatcggcccgatacttggcgcaaccgccgcctttttccggcgcaccgcccaaaaattccccttcatcaagcgcgacaatatcaaaatcattcccttggccgtctgtatgtttgcactcatcggtgtgattgccgtttggtttcccgaaattttgggcaacggcaaagcaggcaaccaactgacttttggcggtttgaccggctggcaatacagccttgagttgaccgctgtcaaatgggcggtcgttttgatggcgctggcggcaggcgcatacggcggactgattacgccgtctatgatgctcggcagcaccatttcttttgcagccgccgccgcgtggaacagcgtcttccccgaaatgccgtctgaaagcgcggcagtcgtcggagcggcggtgtttctcggcgtatcgctcaaaatgccgctgaccgccattgtgttcgtattggaactgacctacgcgccgctgtccctgctgctgcctttgtgcatcggcatggcgggggtattgggaacatcgggaaaaatgggcttcaaa

SEQ ID NO: 6760 - protein, 380 aa, Neisseria gonorrhoeae
MHFIRHTAYGYDADGAYISFREGVAQAFGMRRVAMLTLCGAIAGGGWWLLKRFGKPQIEIKAALKQPLQGLPFLTTVFHVLLQIITVGLGSPLGREVAPREMTAAFAFAGGRRLGLDEGEMRLLIACASGAGLAAVYNVPLASTLFILEAMLGVWTQQAVAAALLTSVIATAVARIGLGDVQQYHPANLAVNTSLLWFSAVIGPILGATAAFFRRTAQKFPFIKRDNIKIIPLAVCMFALIGVIAVWFPEILGNGKAGNQLTFGGLTGWQYSLELTAVKWAVVLMALAAGAYGGLITPSMMLGSTISFAAAAAWNSVFPEMPSESAAVVGAAVFLGVSLKMPLTAIVFVLELTYAPLSLLLPLCIGMAGVLGTSGKMGFK

SEQ ID NO: 6761 - DNA, 399 bp, Neisseria gonorrhoeae; identical to SEQ ID NO: 2901

SEQ ID NO: 6762 - protein, 133 aa, Neisseria gonorrhoeae; identical to SEQ ID NO: 2902

SEQ ID NO: 6763 - DNA, 690 bp, Neisseria gonorrhoeae
gttggctgcagcattacgtctacctgcctttctttgtttactctcatgttcaggtttggaagatttaatattgccttccgtataaacccaaactttcagacccaatacaccatatgtggtgtgcgcttcgctggttgcataatctacatttgcacgtaaagtatgcagtggcacgcgaccttcacgataccattcgctacgggcaatatccgcaccattcagacggcctgaagtcataatcttaatgcctttagcaccagaacgcattgcattttgcattgctcgtttcatagcacgacggaattgaacgcgtttttccaactgctgggcgataccgtcagcaataatttgagcatccaactcaggacggcgaatctcttcaatatttacatgaataggtacacccatcaagacttgcaagtcacgtttcaaaacttcgatatcctcaccttttttaccgataaccacacccggacgagcggagtgaatggtaatgcgtgcagattttgcagggcgttcaataattactcgaccaaccgaagcattggccaatttttgacgcaaataattgcgaacatcgatatcctgcttcaaaacagtagaaaagtcggtacttttagcaaaccattttgaagcccagtctttagttaccgccaggcgaaagcctgtagggttaatcttttgtcccat

SEQ ID NO: 6764 - protein, 52 aa, Neisseria gonorrhoeae
VGCSITSTCLSLFTLMFRFGRFNIAFRINPNFQTQYTICGVRFAGCIIYICT

SEQ ID NO: 6765 - DNA, 390 bp, Neisseria gonorrhoeae
gtgtcagaggctgccgtttttgttaagatatgccgttccgcaatgcagttcagacggcatcgccgccgacaatgcccaaacagaaagcccatcatgaccgcatccatgtacatccttttggtcttggcactcatctttgccaacgcccccttcctcacgaccagactgttcggcgtggccgcgctcaagcgcaaacatttcggacaccacctgatcgagctggcggcaggtttcgcgctgaccgcctctcttgcctacatcctcgaatcccgtgcgggagcggtacacaatcagggttgggagttttacgccaccgtcgtctgcctgtacctcattttcgccttcccgtgtttcgtgcggcggtatttttggcacacgcgcaacagggaa

SEQ ID NO: 6766 - protein, 130 aa, Neisseria gonorrhoeae
VSEAAVFVKICRSAMQFRRHRRRQCPNRKPIMTASMYILLVLALIFANAPFLTTRLFGVAALKRKHFGHHLIELAAGFALTASLAYILESRAGAVHNQGWEFYATVVCLYLIFAFPCFVRRYFWHTRNRE

SEQ ID NO: 6767 - DNA, 327 bp, Neisseria gonorrhoeae
gttacccactgtcacattgatatgacaagtttgtttttcgatgcggttaccgcgacctttggcgcgagcttgaaaacgtttcaagcttggacctttgtcaacaaagatagttaccactttcagttcatcaatgtccgcaccgttattatgctcagcattagcaatagctgactccaatacttttttgatcagctcggcaccttttttagggctgaaagccaaaatattcaaagcttgggcaacgtctttaccacgaatcaaatcagctaccaaacgagccttttgagcagagatacgggcatttttatgttgtgcatttactctcat

SEQ ID NO: 6768 - protein, 56 aa, Neisseria gonorrhoeae
VTHCHIDMTSLFFDAVTATFGASLKTFQAWTFVNKDSYHFQFINVRTVIMLSISNS

SEQ ID NO: 6769 - DNA, 831 bp, Neisseria gonorrhoeae
atgccgcaagccctcgtcctccaatttccctccgccgaagccctgccttccgacttcccctcacgcctgcccgaacctgattatgctgatgaaaagcgtatgcgttttattgttgaagaaggattttctttaagcgaaaaagacgcggcgttactggacagccgtcaaatcgaccacgccgttttgcccaatatggcgtttggcgaactcgggctgattgtcagcgatatggattcgacgctgattaccatcgaatgtatcgatgaaattgcggcaggtgtgggtttgaaaggcaaagtagcggaaattaccgagcgcgccatgcgcggagagttggatttcggacagtctttacgcagccgcgttgcgttgttggcgggattggacgaacagattttggcggacatttatgaaaacgttttgaagctctcgcccggtgcggaatttttgttggacgaatgcaaaaggcacaatgtgaaattcctgctggtgtccggcgggttcacgttttttaccgaaaggctgcaacaacggctcggcttcgaataccaacacgccaatattttggaaattgaaaacggcaggttgaccggccgtctgaaaggcagaatcatcgacgcgcaggcaaaggcggatttattgcgcgaataccgcagccgcctcggattgcagccgcatcaggtgttggcgatgggcgacggtgcgaacgatattccgatactcaaagaagcgggcataggcgtggcttaccgcgccaaaccgaaagcgcgggccgccgccgatgcctgtatcaacttcggcggtttggagcgtgtacgcggcctgttcgga

SEQ ID NO: 6770 - protein, 277 aa, Neisseria gonorrhoeae
MPQALVLQFPSAEALPSDFPSRLPEPDYADEKRMRFIVEEGFSLSEKDAALLDSRQIDHAVLPNMAFGELGLIVSDMDSTLITIECIDEIAAGVGLKGKVAEITERAMRGELDFGQSLRSRVALLAGLDEQILADIYENVLKLSPGAEFLLDECKRHNVKFLLVSGGFTFFTERLQQRLGFEYQHANILEIENGRLTGRLKGRIIDAQAKADLLREYRSRLGLQPHQVLAMGDGANDIPILKEAGIGVAYRAKPKARAAADACINFGGLERVRGLFG

SEQ ID NO: 6771 - DNA, 339 bp, Neisseria gonorrhoeae
ggtattcgcataggcaaccgaatcgtcgccgcttttcttttgaacgaactcgattttgcatccgtcggggtcttctacgaaggctatcacggttgtgccgtgtttcatcaggccggcttcgcggacgacgtttccgccctgccgcttcacgcgttcgcaggcttcgtaggcatcgtccacttcaaccgcgatgtgtccgtaggcgtcgcccaagtcgtatcgtttcgtatcccagttgtgcgtcagttccaaaaccgtgctgtcggtttcgtcgccgtaaccgacgaaggcaagggtaaatctgccttcgggatagtcttttcggcggagcagtttcat

SEQ ID NO: 6772 - protein, 113 aa, Neisseria gonorrhoeae
GIRIGNRIVAAFLLNELDFASVGVFYEGYHGCAVFHQAGFADDVSALPLHAFAGFVGIVHFNRDVSVGVAQVVSFRIPVVRQFQNRAVGFVAVTDEGKGKSAFGIVFSAEQFH

SEQ ID NO: 6773 - DNA, 1416 bp, Neisseria gonorrhoeae
atggaaaatatattgtctgttctggtgggtacagtcaatcggtttctttggggctacctgctgatttatgcgcttttgggtatcggcctgttttttacgctgtatcttggtgcgccgcagattaccaagctgggcgcgggattcaaatccgtattcggcggcttgtttgccaaaggtgataaagacgataagtccttatcgcagtttcaggcgttggcggttgctatatccgcgcaaatcggtacgggcaacgtcgccggtgtggcgaccgccattaccgcaggcgggccgggtgcgattttttggatgtggctttctgccgttttggggatgtccacgatttttgcggaagcactgctggcgcagaaataccgcgtcgtcagccacggcaaatacatcggcgggccggcgttttatattacgcacggtctgactccgaaaatcggcaggggcgcggcgcgtttcctgtcgggctttttctccatcgcgctgattgtcgcgttgggctttatcggcaatgcgactcaggcaaactccatcgcttctgccgttaccattgcatttgatgtgccttctttggcagtcggcattgtgtttgccgtccttgcgggcatggttgtgattggcggcgtgaaccgtattgccaatattgcccggtttgtcgtgccgtttatggcggttgtttatattttgtgcgccgtcgttatcctgtttgaattttccgaccatattgtgccgatgttcaaccacatctttaccgccgccttcaatcccgaggccgttttgggcggtgctgcgggtatcggtatgcgtgaagcgatacgtttcggcgtggcgcgcggtctgttttccaacgaagcaggtatgggttcgactccgcacgcccacgcgactgcggatgtgaagcatcctgttcagcaaggtatgacggcatttgtcggtgtatttatcgatacgattttggtatgtacggctacggcattgattatcctgctgaccgatgccaacctttcgggcgaacagggcgcggcggttactcaatttgcctttaacaaggcatttccgggcttcggttcgcaattgcttgccatgtgtctgaccttcttcgcctttacgaccattatcggctggtattatttcggcgagtccaacatccgttttcttttcaggggaagacacttgggcatctatcgcgcattggttctgcttgctatcgttttgggtacgctcggcaaagtcgatttggtttggagcctgtcggatatgttcaacggctttatggttatccccaacctgattgccttattcttgctgcgtaaggaaatccgcgccatttatgatgactacctgatgcagaaaaaggcgggacaggatttatcctatcagtatgaattccacgagttccacgataaacaa

SEQ ID NO: 6774 - protein, 472 aa, Neisseria gonorrhoeae
MENILSVLVGTVNRFLWGYLLIYALLGIGLFFTLYLGAPQITKLGAGFKSVFGGLFAKGDKDDKSLSQFQALAVAISAQIGTGNVAGVATAITAGGPGAIFWMWLSAVLGMSTIFAEALLAQKYRVVSHGKYIGGPAFYITHGLTPKIGRGAARFLSGFFSIALIVALGFIGNATQANSIASAVTIAFDVPSLAVGIVFAVLAGMVVIGGVNRIANIARFVVPFMAVVYILCAVVILFEFSDHIVPMFNHIFTAAFNPEAVLGGAAGIGMREAIRFGVARGLFSNEAGMGSTPHAHATADVKHPVQQGMTAFVGVFIDTILVCTATALIILLTDANLSGEQGAAVTQFAFNKAFPGFGSQLLAMCLTFFAFTTIIGWYYFGESNIRFLFRGRHLGIYRALVLLAIVLGTLGKVDLVWSLSDMFNGFMVIPNLIALFLLRKEIRAIYDDYLMQKKAGQDLSYQYEFHEFHDKQ

SEQ ID NO: 6775 - DNA, 195 bp, Neisseria gonorrhoeae
ttggaggacgagggcttgcggcataacggcggctcaaaaaatgcggattatatagtgaaacggcaaagaatgttacggcgggcgtgcctgcaatcggaaaacgacttcaaacgcaaacggcagtatgtgtcggacaacacgggaaaatgcgcaactattgccagcctgatgaaaattcgttataaggggattatc

SEQ ID NO: 6776 - protein, 65 aa, Neisseria gonorrhoeae
LEDEGLRHNGGSKNADYIVKRQRMLRRACLQSENDFKRKRQYVSDNTGKCATIASLMKIRYKGII

SEQ ID NO: 6777 - DNA, 276 bp, Neisseria gonorrhoeae
tttctttttagcctttttatcggccaggtggcctttaaaggtacgggtcaatgagaattcgcctaatttatgaccaaccatattgtcgctgataaacacaggcacatgggtgcgaccgttgtgcacggcaatggtcagaccgataaaatcaggcagaatggtagaacgacgagaccaggttttaatcgggcgtttgtcgttgcttgcgcgaacagcatctacttttttcagcaaatgcaggtctacatatgggccttttttcaatgaacgagccat

SEQ ID NO: 6778 - protein, 17 aa, Neisseria gonorrhoeae
FLFSLFIGQVAFKGTGQ

SEQ ID NO: 6779 - DNA, 1536 bp, Neisseria gonorrhoeae
atgaaaatcggtatcccacgcgagtcattatccggcgaaacccgcgtcgcctgcacgcccgccaccgttgccctgctgggcaaactaggctttgaaaccgttgtcgaaagcggtgcaggtttggcggcaagtttggacgatgccgcttaccaaacagcaggcgcaaccgttgccgacaaagcggcggtttgggcctgccctttaatttataaggtcaacgcgccgtccgaaggcgagctgccgctgctcaaagaaggtcaaaccatcgtcagcttcctgtggccgcgccaaaacgaggctttggtcgaggccttgcgcgccaagaaagtcaacgcgctggcgatggacatggttccccgcatttcccgcgctcaggccttggacgctttgtcttcaatggcaaacatcagcggctaccgcgccgtgattgaagccgccaacgccttcggccgtttcttcaccggtcaaatcactgccgccggcaaagtgccgcctgcgcaggttttggtgattggcgccggtgtggcgggtttggcggcaatcggtacggcaaattcgctcggcgcagtggtgcgcgcgttcgatacccgcttggaagtggcggaacaaatcgaatcgatgggcggtaagttcctgaaactcgacttcctgcaagaatcgggcggcagcggagacggctacgccaaagtgatgagcgacgaatttatcgccgccgaaatgaagctctttgccgaacaggcgaaagaagtggacatcatcatcaccaccgccgccattccgggcaaacccgctcccaagctgattaccaaagaaatggtggaaagcatgaaatccggatccgtcatcgtcgatttggcggcgacgggcggcaactgcgaactcacccgaccgggcgaattgtccgtaaccggcaacggcgtgaaaatcatcggctacaccgacatggcaaaccgccttgccggacagtcttcccagctttacgccaccaacttggtgaacctgaccaagctgttaagcccgaacaaagacggcgaaatcacgctggacttcgaagacgtgattatccgcaatatgaccgttacccgcgacggcgaaatcaccttcccgcctccgccgattcaggtttccgcccggccgcagcaaacgccgtctgaaaaagccgcgcctgccgccaagcccgagccgaaacctgttcccctgtggaaaaaactcgcgcccgccgccatcgccgccgtattggtgctgtgggtccgcgcggtcgcacccgcagcattcttgaaccactttatcgtcttcgtcctcgcctgcgtcatcggctaccatgtcgtttggaacgtcagccactcgctgcacacaccgctgatgtcggtaaccaacgccatctccggcatcatcgtcgtcggcgcgctgctgcaaatcggtcagggcaacggcttcgtttcgctgctgtcgtttgttgccatcctgattgccggcatcaatatcttcggcggctttgcggttacacggcgtatgctgaatatgtttaagaaaggg

SEQ ID NO: 6780 - protein, 512 aa, Neisseria gonorrhoeae
MKIGIPRESLSGETRVACTPATVALLGKLGFETVVESGAGLAASLDDAAYQTAGATVADKAAVWACPLIYKVNAPSEGELPLLKEGQTIVSFLWPRQNEALVEALRAKKVNALAMDMVPRISRAQALDALSSMANISGYRAVIEAANAFGRFFTGQITAAGKVPPAQVLVIGAGVAGLAAIGTANSLGAVVRAFDTRLEVAEQIESMGGKFLKLDFLQESGGSGDGYAKVMSDEFIAAEMKLFAEQAKEVDIIITTAAIPGKPAPKLITKEMVESMKSGSVIVDLAATGGNCELTRPGELSVTGNGVKIIGYTDMANRLAGQSSQLYATNLVNLTKLLSPNKDGEITLDFEDVIIRNMTVTRDGEITFPPPPIQVSARPQQTPSEKAAPAAKPEPKPVPLWKKLAPAAIAAVLVLWVRAVAPAAFLNHFIVFVLACVIGYHVVWNVSHSLHTPLMSVTNAISGIIVVGALLQIGQGNGFVSLLSFVAILIAGINIFGGFAVTRRMLNMFKKG

SEQ ID NO: 6781 - DNA, 831 bp, Neisseria gonorrhoeae
acctttatttgagtaacggcgacgaacaatcatattatccgtgcgtttgttattacgagtgcggtagcctttagcaggagtaccccatggactaaccggttcgcgggcttcgccggtacggccttcaccaccaccatgcgggtgatcgacgggattcatgacaacaccgcgtacggtcggacgaataccgcgccaacggttagcaccggctttaccgatttttttcaggctttgctcttcgttaccgacttcaccgatggtcgcacggcaatctacgttgattttacgaacttcgccagagcgcagacggacttgagcgtatgcaccttctttagccaacaataccgcagaagcaccggcagaacgtgcgatttgagcacctttaccgggtttcatttcgatacagtggatagtcgtaccaacgggaatgttgcggatcggcagggtgttgcctactttgatggcagcttcagcaccggaaaccaatacgacaccggcttgaataccgcgaggagcgatgatgtaacgacgctcgccgtctgcatagcacaacagtgcgatgaaggcagtacggttaggatcgtattcgatacgctctactttagcagaaatgccgtctttgttacgtttaaagtctacaacacggtaatggtgtttatgaccgccgcctttgtgacgggtggtgatatgaccattattgttacggccggcagtagaatttttcttttcaagcaagggtgcataaggtgcacctttgtgcaaaccttctgttaccacgcgaaccatgccgcgacggcctgcagaggtcggcttcattttaacgattgccat

SEQ ID NO: 6782 - protein, 273 aa, Neisseria gonorrhoeae
VTATNNHIIRAFVITSAVAFSRSTPWTNRFAGFAGTAFTTTMRVIDGIHDNTAYGRTNTAPTVSTGFTDFFQALLFVTDFTDGRTAIYVDFTNFARAQTDLSVCTFFSQQYRRSTGRTCDLSTFTGFHFDTVDSRTNGNVADRQGVAYFDGSFSTGNQYDTGLNTARSDDVTTLAVCIAQQCDEGSTVRIVFDTLYFSRNAVFVTFKVYNTVMVFMTAAFVTGGDMTIIVTAGSRIFLFKQGCIRCTFVQTFCYHANHAATACRGRLHFNDCH

SEQ ID NO: 6783 - DNA, 1443 bp, Neisseria gonorrhoeae
atgaattggtcagatttgaatttaatgcccgcactgcccgaagtcgcgctgctgtcgctgctggtgttattgttgccggcggacttgtgggccagtgatgacaaatgccgttggacgcattacggcgcgttggcaacggtggcggttacggcggcggtgcagcttgccgtgtgggaacagggcagcacgtcttcgttcaacgggatgtatattgcggacggtatgtcgcgtttggcaaaaatggttttatatgccttgacgtttgtcctgtttgtctatgccaagccctacaaccaagtgcgcggtattttcaaaggcgagttttacaccctgtcgctgtttgccctcttgggcatgagcgtgatggtgagcgcggggcattttttaactgcctatatcggtttggaactcttgtcgctcgccctttacgccctgattgccctgcgccgcgattccggttttgccgccgaagccgccttgaaatattttgttctgggcgcgctggcatccggcctgctgctctacggtatttctatggtttacggcgcaaccggttcgctggaatttgccggcgtgctcgcctcttccttcaatgaagaagctaacgaatggctgttgaaactgggtctggtgtttatcgtcgtcgccgttgcgttcaaactcggcgcggtaccgttccatatgtggatgcccgacgtgtatcacggcgcgcccacttctgttaccgccttggtcggcactgccccgaaaatcgccgccgtcgttttcgctttccgcatcctcgttaccgggctgggaaccgtgcatcatgactggtctctgatgtttgccctgcttgccgccgcctcgctgctggtcggcaaccttgccgccatcatgcagaccaatatcaaacgtatgctcgcctattccaccgtatcgcatatgggtttcatcctgttggcgtttatggcgggcgcggtcggctttgcggcgggcctctattacgccattacctacgcgctgatggcggcggcagggttcggcgtgttgatggtgttgtcggacggggacaacgagtgcgaaaacatcagcgatttggcagggttgaaccaacaccgcgtatggcttgcctttttgatgctgctggttatgttctctatggcgggcattccgccgctgatgggtttttacgccaaattcggcgttattatggcgcttttgaaacaaggctatgtatggttgtcggtgtttgccgtcgtgatgtcgctggttggcgcgttctactacctgcgcgtggtcaaagtcatgtattttgacgaatccggccgcgcccgtcccgccgccggcggcaacaatgccgcaaaatccctcttaagcgtcaacgcgctgctgttggtgctgtggggcattatgccgcaaaccgttatcgactggtgcgccaaggcgttggagaacacgctg

SEQ ID NO: 6784 - protein, 481 aa, Neisseria gonorrhoeae
MNWSDLNLMPALPEVALLSLLVLLLPADLWASDDKCRWTHYGALATVAVTAAVQLAVWEQGSTSSFNGMYIADGMSRLAKMVLYALTFVLFVYAKPYNQVRGIFKGEFYTLSLFALLGMSVMVSAGHFLTAYIGLELLSLALYALIALRRDSGFAAEAALKYFVLGALASGLLLYGISMVYGATGSLEFAGVLASSFNEEANEWLLKLGLVFIVVAVAFKLGAVPFHMWMPDVYHGAPTSVTALVGTAPKIAAVVFAFRILVTGLGTVHHDWSLMFALLAAASLLVGNLAAIMQTNIKRMLAYSTVSHMGFILLAFMAGAVGFAAGLYYAITYALMAAAGFGVLMVLSDGDNECENISDLAGLNQHRVWLAFLMLLVMFSMAGIPPLMGFYAKFGVIMALLKQGYVWLSVFAVVMSLVGAFYYLRVVKVMYFDESGRARPAAGGNNAAKSLLSVNALLLVLWGIMPQTVIDWCAKALENTL

SEQ ID NO: 6785 - DNA, 381 bp, Neisseria gonorrhoeae
atgactttcgcctattggtgcattctgattgcctgcctattgccgcttttttgtgcggcgtatgccaaaaaagcgggcggattccggtttaaagacaaccacaatcctcgcggttttctggcacatacgcaaggcgcagccgcccgtgcccacgccgcgcagcaaaacggttttgaagcctttgcaccgtttgccgccgccgttttgacggcacacgcaaccggcaatgccggacaagcaaccgtcaacacgcttgccggattgttcatcctgttccgcctcgcctttatctggtgctacatcgcagacaaagcagcattgcgctcgctgatgtgggcgggcggatttgcctgcaccgtcggactgtttgtcgcggctgct

SEQ ID NO: 6786 - protein, 127 aa, Neisseria gonorrhoeae
MTFAYWCILIACLLPLFCAAYAKKAGGFRFKDNHNPRGFLAHTQGAAARAHAAQQNGFEAFAPFAAAVLTAHATGNAGQATVNTLAGLFILFRLAFIWCYIADKAALRSLMWAGGFACTVGLFVAAA

SEQ ID NO: 6787 - DNA, 99 bp, Neisseria gonorrhoeae
ttgaaacagatgccgtctgaaaacacgaacgtcaatttttcagacggtattgaaaacaaatcatcgaaaatcggagaatttccatgtcttcaggactcg

SEQ ID NO: 6788 - protein, 33 aa, Neisseria gonorrhoeae
LKQMPSENTNVNFSDGIENKSSKIGEFPCLQDS

SEQ ID NO: 6789 - DNA, 318 bp, Neisseria gonorrhoeae
ttccttatctgcagctgcagcagcggcttccaaatccaactcttgaccgtcaaccaagcttacataagcttttttaacatcgctgcggcgacccaaaatacgaccaaaacgcttagttttgcctttagtggtaacggtagttacagaagcaacttgaacaccgaacagcagctcgacagcagctttgatttcaggtttggttgcatttgccaagactttaaacgtcatttggttgcatttttcagccaatacgttgcttttttcagaaacgacaggcaccaagattacttgagtcaaacgttgttgattcatacccat

SEQ ID NO: 6790 - protein, 106 aa, Neisseria gonorrhoeae
FLICSCSSGFQIQLLTVNQAYISFFNIAAATQNTTKTLSFAFSGNGSYRSNLNTEQQLDSSFDFRFGCICQDFKRHLVAFFSQYVAFFRNDRHQDYLSQTLLIHTH

SEQ ID NO: 6791 - DNA, 1617 bp, Neisseria gonorrhoeae
ttgggaataagtaaagaaggggggagagtattcattccttctttcagacgacttcctaaaacgctgtctgtaaagaccaacccatacaactatattttttattttaaccacaggttaaccactatgttttccaactacctactcagcttggcaatatggatacccatcgccgcaggcgtgctggttttggcgaccggtaaagacagccgtgcgccgctggcgcgtgtgcttgccttcatgggagcgcttgccggtttcttggtaacgctgcccctgtttaccggtttcgaccgtttgagcggcggctatcaatttaccgagttccacgagtggattccgcttctgaaaatcaactacgcattgggcgtggacggtatttcagtgctctttatcatcttgaatgcgtttattacgctgctggtggtattggccggttgggaagtcattcagaaacgtccggcgcagtatatggcggcattcctgatgatgtcgggtttgattaacggcgcgtttgccgcgcaggatgcgattctgttttatgtgttcttcgagggtatgctgattccgctgtacctgattatcggtgtatggggcggcccgcgccgcgtctatgcgtcggtcaagctgttcctctatacgctgacgggttcgctcttgatgttggttgccatggtttacctgtactatcagacaggcagcttctctattgtcgatttccaaaacatcaaacagattccgttgggcgtacaacagcttttgtttgtagcgttcttcctgtcatttgccgtaaaagtgccgatgttccccgtacacacttggctgccggatgcccacgttgaagcgccgaccggcggttcgatggtgttggcggcaattacgctgaaactgggtgcgtatggtttcttgcgctttatcctgccgattatgccggacgcggctcgctattttgcccccgtaatcatcgtattgagcctgattgccgtaatttatatcggtatggtggccctggtgcaaaccgatatgaagaaactggtggcgtattcgtccatcagccatatgggttttgtaacgcttgggatgtttttgtttgttgacgggcagttggacgactgggcgttgaaaggcgcggtcattcagatgatttcgcacggcttcgtgtcggcggcgatgtttatgtgcatcggcgtgatgtacgaccgcctgcacacgcgcaatattgccgattacggcggcgtggtcaatgtgatgcccaagtttgcggcgtttatgatgttgttcggtatggcgaacgccggcctgcctgcgacttccggcttcgtgggcgagtttatggtggttatgggcgcggtcaaagtgaatttctgggtgggcgcgctggcggctatgacgctgatttacggcgcgtcttataccctgtggatgtacaagcgcgtgattttcggcgcgattcacaatccgcacgttgccgaaatgaaagacatcaattgccgcgagtttgcgattctggcggttttggcggttgctgttttggggatgggcctgtatccgaacgcatttatcgaagtggtgcatcaggcggcaaacgatttgattgcccatgtggcgcaaagcaagatt

SEQ ID NO: 6792 - protein, 539 aa, Neisseria gonorrhoeae
LGISKEGGRVFIPSFRRLPKTLSVKTNPYNYIFYFNHRLTTMFSNYLLSLAIWIPIAAGVLVLATGKDSRAPLARVLAFMGALAGFLVTLPLFTGFDRLSGGYQFTEFHEWIPLLKINYALGVDGISVLFIILNAFITLLVVLAGWEVIQKRPAQYMAAFLMMSGLINGAFAAQDAILFYVFFEGMLIPLYLIIGVWGGPRRVYASVKLFLYTLTGSLLMLVAMVYLYYQTGSFSIVDFQNIKQIPLGVQQLLFVAFFLSFAVKVPMFPVHTWLPDAHVEAPTGGSMVLAAITLKLGAYGFLRFILPIMPDAARYFAPVIIVLSLIAVIYIGMVALVQTDMKKLVAYSSISHMGFVTLGMFLFVDGQLDDWALKGAVIQMISHGFVSAAMFMCIGVMYDRLHTRNIADYGGVVNVMPKFAAFMMLFGMANAGLPATSGFVGEFMVVMGAVKVNFWVGALAAMTLIYGASYTLWMYKRVIFGAIHNPHVAEMKDINCREFAILAVLAVAVLGMGLYPNAFIEVVHQAANDLIAHVAQSKI

SEQ ID NO: 6793 - DNA, 1383 bp, Neisseria gonorrhoeae
atgtcttcaggactcgtaacagcggcgtatatcgttgccgcaattttattcatcttctcactggcggggctgtccaaacaggaaaccgccaaacggggctgctattccggtatcgccggtatggcggtcgccctcttcgtaacggtcttttccgacaatacccacggactgggctggattatcatcgccatgctcatcggcgcggcaatcggcatccacaaagccaaaaaagtagaaatgaccgaaatgcccgaactgattgcacttctgcacagcttcgtcggcttggcagccgttttggtcggcttcaacagctacatcgagccgggcaacgtttcgcacgatatgcacaccatccatctggtcgaagtctatttgggcattttcatcggcgcggtaacctttaccggctcactggccgcattcggcaaactcaacggcaaaatcagcagcagcccgctgcaactgcccgccaaacacaagctcaacgcactggcgctcgccgtatcgtttgtgttgctgctcgtatttgtcggcattgacggcagcggcttcatccttctgattatgaccctgatcgccctcgcattcggctggcacttggttgcctccatcggcggcgcggatatgcccgtggtcgtatctatgctcaactcctactccggctgggcggccgcagcggcaggctttatgctctccaacgacctgctcatcgttaccggcgcgctggtcggctcaagcggcgcaattctgtcctacattatgtgcaaagccatgaatcggtcgtttgtttccgtgattgccggcggtttcggcagcgacagcggcatatcgtcttccggcagccaagagatagaggaataccgagaagtcaaagctgccgatgttgccgaaatgctgaaaggcgcaagcagcgtcattatcaccccgggctacggcatggcagtggcgcaggcacaataccccgttgccgaaatcaccgagcttttgcgtaaaaacggcatcgaagtacgcttcggcatccaccccgtcgccggccgcctgcccggtcatatgaatgtactgctcgccgaagccaaagtcccctacgacattgttttggaaatggacgaaatcaacgacgacttccccgaaaccgatgtggtcttggtgattggtgcgaacgataccgtcaaccctgccgcccaaaccgatccgaacagcccgattgcaggtatgccggttttagaagtatggaaggcaaaagaagtcgtcgtattcaaacgctcgatgaacaccggctacgcaggcgtacaaaacccgctgttcttcaacgaaaacagcgtgatgtgtttcggcgacgcgaagaaaaccgttgacgggattttggcggaattgaaaaaa

SEQ ID NO: 6794 - protein, 461 aa, Neisseria gonorrhoeae
MSSGLVTAAYIVAAILFIFSLAGLSKQETAKRGCYSGIAGMAVALFVTVFSDNTHGLGWIIIAMLIGAAIGIHKAKKVEMTEMPELIALLHSFVGLAAVLVGFNSYIEPGNVSHDMHTIHLVEVYLGIFIGAVTFTGSLAAFGKLNGKISSSPLQLPAKHKLNALALAVSFVLLLVFVGIDGSGFILLIMTLIALAFGWHLVASIGGADMPVVVSMLNSYSGWAAAAAGFMLSNDLLIVTGALVGSSGAILSYIMCKAMNRSFVSVIAGGFGSDSGISSSGSQEIEEYREVKAADVAEMLKGASSVIITPGYGMAVAQAQYPVAEITELLRKNGIEVRFGIHPVAGRLPGHMNVLLAEAKVPYDIVLEMDEINDDFPETDVVLVIGANDTVNPAAQTDPNSPIAGMPVLEVWKAKEVVVFKRSMNTGYAGVQNPLFFNENSVMCFGDAKKTVDGILAELKK

SEQ ID NO: 6795 - DNA, 618 bp, Neisseria gonorrhoeae
tacccattgctcctctaattgtgcaaccgcatctttagtgatgattacttttttataacgcagcaagctgtaaggatcaacttgttgagcttccaaaaccaatacgtttggcaagttgcgtgaagccaagtaaacattctcgtcgagccgtttggttacaaacagcacttgctccagagccaaattttttacttgttcggcaaaaactttggttttgggagtttcggcagtcaacgcctcaatcacaaacaaacgctcgtcacgcgccaattgggacaggatagtcgccataccggcacggtacattttacggtttactttttgagtgaagttttcgtcgggtttgttcgggaacgcgcgaccgcctttacgccacagcggagaagaagtcataccggaacgggcgcggccggtacctttttgacgccatggttttttggttgagtgttttacttcggcacgggttttttgagcacggttaccagagcgggcgtttgccaagtaggcatttaccagctggtgaaccaacgcttcattgtattcgcgggcgaacaaagcatcagaaacagacaggctgcctgaaacttgtcctttagcgtcaattactttcaattccat

SEQ ID NO: 6796 - protein, 5 aa, Neisseria gonorrhoeae
YPLLL

SEQ ID NO: 6797 - DNA, 1014 bp, Neisseria gonorrhoeae; identical to SEQ ID NO: 135

SEQ ID NO: 6798 - protein, 338 aa, Neisseria gonorrhoeae; identical to SEQ ID NO: 136

SEQ ID NO: 6799 - DNA, 699 bp, Neisseria gonorrhoeae
cgcacctactttcacgctgggacgaactacaacatcgctgttgaccgcacccggaacagcacccttaaccaacagcagttggcgttctgcatcaacacggacaacttccaatttttgaacagttgctttggtgttgccgtattggccggccatgcgcttaccggggaacacgcgacccgggtcttgcgccataccgatagagcctggaacgcggtgagaacgggagttaccgtgggaagtacgttgggcaccgaagttatgacgtttgatcgtgccggagaaacctttacctttagaggtaccggttacatcgaccagttgaccgacttcaaacatagaaacggtgatttcgtcaccggctttcaattcagccagtttttcttcagtcaaagcaaactcaatcaaaccgcgaccggcttcaacacctgcttttgcaaagtgtccggcttcggctttgttgacacgattggcttttttctgaccaaaggtaacttgaacggcggtatagccgtcagtatctttggattttacttgtgtaacgcggttggcagacatatccaaaacggttaccggaacagaaacaccctgctcgtcgaacacgcgggtcataccaactttgcgtccaaccagacctaaagtcatgattattttccttttaaagtaaagggacaggctgcgattggcctgtctttcagacaa

SEQ ID NO: 6800 - protein, 211 aa, Neisseria gonorrhoeae
RTYFHAGTNYNIAVDRTRNSTLNQQQLAFCINTDNFQFLNSCFGVAVLAGHALTGEHATRVLRHTDRAWNAVRTGVTVGSTLGTEVMTFDRAGETFTFRGTGYIDQLTDFKHRNGDFVTGFQFSQFFFSQSKLNQTATGFNTCFCKVSGFGFVDTIGFFLTKGNLNGGIAVSIFGFYLCNAVGRHIQNGYRNRNTLLVEHAGHTNFASNQT

SEQ ID NO: 6801 - DNA, 144 bp, Neisseria gonorrhoeae
ttgtttgtttcgttgattttgtgtcagtttcagatgtgggtgcttatccggacgggtcgtctgaaaatgtttgccccaatgcaaaaaaatcactgcaaaccttcacaaacggggctggtagtgattttttcaaatcaaacagat

SEQ ID NO: 6802 - protein, 48 aa, Neisseria gonorrhoeae
LFVSLILCQFQMWVLIRTGRLKMFAPMQKNHCKPSQTGLVVIFSNQTD

SEQ ID NO: 6803 - DNA, 129 bp, Neisseria gonorrhoeae
atggtacccaacaggcgtgaaatagccaacatgcaaattatctgtttcctaaattttttaggcaatctcaacaaatatagaggagtcaaaagggatgacacagttatttttacattcagatacaccaaa

SEQ ID NO: 6804 - protein, 43 aa, Neisseria gonorrhoeae
MVPNRREIANMQIICFLNFLGNLNKYRGVKRDDTVIFTFRYTK

SEQ ID NO: 6805 - DNA, 126 bp, Neisseria gonorrhoeae
ttggcctgtctttcagacaaagttaaacttggcaaaaatgtaccaagcttgacattatatccgacaagtcaaagaaatatcaacagaaatatcagaaatatcttcaatatgccgtctgaagcgttt

SEQ ID NO: 6806 - protein, 42 aa, Neisseria gonorrhoeae
LACLSDKVKLGKNVPSLTLYPTSQRNINRNIRNIFNMPSEAF

SEQ ID NO: 6807 - DNA, 576 bp, Neisseria gonorrhoeae
atgaatattttattattagacggcggcaaagcgttcggacattctcacggcgggttaaaccacacgcttcacaaaaaagcgaaagaagttttgaccgcgctcggacacaatgttcaagaaaccgtgattgatgccggctatgatgttgaggcggaaatcgaaaaattcgtttggatggatgctgtgatttggcagatgccgggctggtggatgcacgagccttggacagtgaaaaaatatatggacgaagtctttaccggcggacacggcaaactctaccaaagcgacggcagacaccgcgtcaatccgactgagggctacggcacaggcggcttgttgcaaggcaaaaaacatatgctttcactgacttggaatgcgccgattgaagcctttacccgcgaaggcgatttctttgaaggcaaaggcgttgatgttttgtatatgcacttccacaaagccaacgagttcatcggcttgagccgcctgccgacattcttatgtaacgatgtggttaaaaatccgcaagtggaaaaatacttggcagattatcaggcacacttggaaaaagtgttcggc

SEQ ID NO: 6808 - protein, 192 aa, Neisseria gonorrhoeae
MNILLLDGGKAFGHSHGGLNHTLHKKAKEVLTALGHNVQETVIDAGYDVEAEIEKFVWMDAVIWQMPGWWMHEPWTVKKYMDEVFTGGHGKLYQSDGRHRVNPTEGYGTGGLLQGKKHMLSLTWNAPIEAFTREGDFFEGKGVDVLYMHFHKANEFIGLSRLPTFLCNDVVKNPQVEKYLADYQAHLEKVFG

SEQ ID NO: 6809 - DNA, 909 bp, Neisseria gonorrhoeae
atgaaaaccaattcagaagaactgaccgtatttgttcaagtggtggaaagcggcagcttcagccgtgcggcggagcagttggagatggcaaattctgccgtaagccgcatcgtcaaacggctggaggaaaagttgggcgtgaacctgctcaaccgcaccacgcggcaactcaatctgacggaagaaggcgcgcaatatttccgccgcgcgcagagaatcctgcaagaaatggcagcggcggaaaccgaaatgctggcagtgcacgaagtaccgcaaggcgtgttgcgcgtggattccgcgatgccgatggtgctgcatctgctggcgccgctggcagcaaaattcaacgaacgctatccgcatatccgactttcgctcgtttcttccgaaggctatatcaatctgattgaacgcaaagtcgatattgccttacgggccggagaattggacgattccgggctgcgtgcacgccatctgtttgacagccacttccgcgtagtcgccagtcctgaatatttagcaaaacacggcacgccacaatctgcagaagatcttgccaaccatcaatgtttaggcttcacagaacccggttctctaaatacatgggcggttttagatgcgcagggaaatccctataaaatttcaccgcactttaccgccagcagcggtgaaatcttacgctcgttgtgcctttcaagttgcggtattgcttgcttatcagattttttggttgacaacgacatcactgaaggaaagttaattcccctattcgccgaacaaacctccaataaaacacacccctttaatgctgtttattacagcgataaagccgtcaacctccgcttacgcgtatttttggattttttagtgaaggaactgggaaaaaatatgaatagaacgaataccaaa

SEQ ID NO: 6810 - protein, 303 aa, Neisseria gonorrhoeae
MKTNSEELTVFVQVVESGSFSRAAEQLEMANSAVSRIVKRLEEKLGVNLLNRTTRQLNLTEEGAQYFRRAQRILQEMAAAETEMLAVHEVPQGVLRVDSAMPMVLHLLAPLAAKFNERYPHIRLSLVSSEGYINLIERKVDIALRAGELDDSGLRARHLFDSHFRVVASPEYLAKHGTPQSAEDLANHQCLGFTEPGSLNTWAVLDAQGNPYKISPHFTASSGEILRSLCLSSCGIACLSDFLVDNDITEGKLIPLFAEQTSNKTHPFNAVYYSDKAVNLRLRVFLDFLVKELGKNMNRTNTK

SEQ ID NO: 6811 - DNA, 2022 bp, Neisseria gonorrhoeae
atgaacgatatgactttatatttgataattgcccttgttccgttggcaggctcgctgattgcgggtttgttcggcaacaaaatcgggcgtgccggcgcgcatacggttacgatactcggtgtcgctgtatctgccgtgctgtcggcttatgtgctgtggggattcctcaatggcagccgtaccaagtttgacgaaaacgtctatacctggctgacaatgggcggcttggatttttccgtcggcttcttggtcgatacgatgacggcgatgatgatggtcgtggtaacgggcgtgtcgttgatggtgcatatctataccatcggttatatgcacgatgaaaaagtcggctaccaacgcttcttcagctatatttctttgtttactttcagcatgttgatgctgattatgagcaacaacttcatccagctcttcttcggttgggaagcggtgggcttggtgtcgtatctcttgatcggtttctatttcaaacgtccgagcgcgacatttgccaacctgaaagcctttttgatcaaccgtgtcggcgacttcggctttttgctcggtatcggcttggtgcttgcctatttcggcggcagcctgcgttatcaggacgtattcgcctatctgcccaacgtacaaaatgccactatccagcttttccccggcgtggaatggtctttgattaccgtaacctgtttgctcctgtttgtcggtgcgatgggtaaatcggcacaattcccgctgcacgtctggctgcctgattcgatggaaggcccgactccgatttctgcattgattcacgccgcgacgatggttaccgccggtttgtttatggtgtcgcgtatgtcgccgatttatgagatgagcagcaccgcgctgtcggtcattatggtaatcggcgcgattaccgccctgtttatgggcttcttgggtgtgattcaaaacgacatcaaacgtgtggttgcgtattctaccctgtcgcaactgggctacatgaccgtggctctgggcgcgtccgcctattctgtggcgatgttccacgtcatgacccacgccttctttaaagccttgctgttcttggcggcgggcagtgcgattatcggtatgcaccacgatcaagatatgcgccatatgggcaacctgaaaaaatacatgccgattacttggctgactatgctgatcggcaatttgtctctgatcggtacgccgttcttctccggcttctactccaaagattcgattatcgaagcagtgaaatacagcaccctgccgggcagcggcgttgcctattttgccgtcctcgccagcgtgttcgttaccgcgttttacgcgttccgccaatactttatggtgttccacggcgaagaaaaatggcgcagcctgcccgaacaccattcagacggccatggtgaagaacatcacggcttgggcaaaaacgacaatccgcacgaaagcccgctggtcgttaccctgccgctgattctgcttgcgattccgtccgtcatcatcggctacatcgccatcgaacccatgctctacggcgatttcttcaaagacgtgattttcgtcaacgccgacgcgcatccgaccatgcacatcatgaaagaagagttccacggcgcattggcaatggtgtcgcacagcttgacatcgcctgttttgtatttggcggctgccggtgttgccgccgcgtggcttttgtacgtcaaactgccgcacctgcccgctaaaatcgcgcaggcgttccgtccggtttacgttttgtttgaaaacaaatactacctcgacgccttgtatttcaacgtcttcgccaaaggcacgcgcgcattgggaaacttcttctggaaagtcggcgataccgccattatcgacaacggcatcgtcaacggctccgccaaactggtcggcgcgattgccgctcaggtacgcaaagcccaaaccggctttatctacacctacgccgccgctatggtgttcggcgtattggtcttgctcggcatgaccttctggggcttgttcaga

SEQ ID NO: 6812 - protein, 674 aa, Neisseria gonorrhoeae
MNDMTLYLIIALVPLAGSLIAGLFGNKIGRAGAHTVTILGVAVSAVLSAYVLWGFLNGSRTKFDENVYTWLTMGGLDFSVGFLVDTMTAMMMVVVTGVSLMVHIYTIGYMHDEKVGYQRFFSYISLFTFSMLMLIMSNNFIQLFFGWEAVGLVSYLLIGFYFKRPSATFANLKAFLINRVGDFGFLLGIGLVLAYFGGSLRYQDVFAYLPNVQNATIQLFPGVEWSLITVTCLLLFVGAMGKSAQFPLHVWLPDSMEGPTPISALIHAATMVTAGLFMVSRMSPIYEMSSTALSVIMVIGAITALFMGFLGVIQNDIKRVVAYSTLSQLGYMTVALGASAYSVAMFHVMTHAFFKALLFLAAGSAIIGMHHDQDMRHMGNLKKYMPITWLTMLIGNLSLIGTPFFSGFYSKDSIIEAVKYSTLPGSGVAYFAVLASVFVTAFYAFRQYFMVFHGEEKWRSLPEHHSDGHGEEHHGLGKNDNPHESPLVVTLPLILLAIPSVIIGYIAIEPMLYGDFFKDVIFVNADAHPTMHIMKEEFHGALAMVSHSLTSPVLYLAAAGVAAAWLLYVKLPHLPAKIAQAFRPVYVLFENKYYLDALYFNVFAKGTRALGNFFWKVGDTAIIDNGIVNGSAKLVGAIAAQVRKAQTGFIYTYAAAMVFGVLVLLGMTFWGLFR

SEQ ID NO: 6813 - DNA, 414 bp, Neisseria gonorrhoeae; identical to SEQ ID NO: 3727

SEQ ID NO: 6814 - protein, 138 aa, Neisseria gonorrhoeae; identical to SEQ ID NO: 3728

SEQ ID NO: 6815 - DNA, 1452 bp, Neisseria gonorrhoeae
atgagcatcgaacacactcctccgacacacgacggcgaaaccggtcaaaaccatgccgaacgcccttccgccgatttcgaccgtgtccactccctctgcgaaatcctcgaacctgcttttgaacaaatcgaaaacggcacaccgctcgaagatgcgccgctgcgcgacaaactgaccgagctgaccgtcctcttggccgagttgcaccctgccgacgtggccgacgtcttggagtccctgccgccgcgcgaacgcaatatcgtttggcttctggtcaaacccgaagacgacggcgaagtattgctggaagtatccgacgcggtgcgagaaacgctgatcgagtcaatggacaaggacgaattgttggcggcggtcgatgatttggatgcggacgaattggcggagctggcagacgatttgccgcaccaagtggtttatgaagccttacagacgcgcgatgaggaagagcgcgcccaagtcaaggcggcaatgtcgtatgaagacaaccaagtcggtgcgattatggacttcgagttggtcagcatccgcgccgatgtcgcctgcgaagtggtgctgcgttatctgcgccgcttcgacagcctgcccgaccataccgacaagatttttgtcgtcgatgaaaacgacgtgctgcagggcgtgctgcccatccgcaaacttttggtcgccgatcccgaagatttggtggaaaacgtgatggcgaaagatgtcgtgcgtttccgcgccgaggacgacgtggaagaagcggcgcaggcgtttgaacgctacgacttggttaccgcgcccgtcgttgatgaaaacaaaaagctcatcggcaggattaccatcgacgagatggtggacgtgatccgcgaagaatccgaagcggatatgttgaacatggcaggtttgcaggaagaggaagacctgttcgcccccgtcttggattccgtcaaaaaccgctggatgtggctcgccgtcaacctctgcaccgccttcctcgccagccgcgtcatcggcgcgtttgaaggcagtatcgaaaaaatcgtcgcactcgccgcgctgatgcccatcgtcgccggcatcggcggtaactcgggcaaccagacgattaccatgattgtccgcgcgatggcgatggggcagctgacggatatgcaggcgggaaggctgttgaaaaaagaagtcggcgtcgccttggtcaacggcattatttgggggacggtgatgggagcggtttcgtggctgctttacggcagcctcggcatcggtttggtcatggttgccgcgatgacgctcaacctcctgctggcggcaacggtcggcgtattgattcccgtggtaatggaaaaattcggacgcgatcccgcgctgggcagctcggtgctgattaccgccgttaccgactccggcggcttcctcattttcttgagtctcgccaccctgttcctgctt

SEQ ID NO: 6816 - protein, 484 aa, Neisseria gonorrhoeae
MSIEHTPPTHDGETGQNHAERPSADFDRVHSLCEILEPAFEQIENGTPLEDAPLRDKLTELTVLLAELHPADVADVLESLPPRERNIVWLLVKPEDDGEVLLEVSDAVRETLIESMDKDELLAAVDDLDADELAELADDLPHQVVYEALQTRDEEERAQVKAAMSYEDNQVGAIMDFELVSIRADVACEVVLRYLRRFDSLPDHTDKIFVVDENDVLQGVLPIRKLLVADPEDLVENVMAKDVVRFRAEDDVEEAAQAFERYDLVTAPVVDENKKLIGRITIDEMVDVIREESEADMLNMAGLQEEEDLFAPVLDSVKNRWMWLAVNLCTAFLASRVIGAFEGSIEKIVALAALMPIVAGIGGNSGNQTITMIVRAMAMGQLTDMQAGRLLKKEVGVALVNGIIWGTVMGAVSWLLYGSLGIGLVMVAAMTLNLLLAATVGVLIPVVMEKFGRDPALGSSVLITAVTDSGGFLIFLSLATLFLL

SEQ ID NO: 6817 - DNA, 282 bp, Neisseria gonorrhoeae
atgttcggcggtcgtctgaaaaactctccatccattaccgccaaacactttttgaaggaaaatatcatgaaatttattaacacctgccgtaaatacggcgcaaaactggctgttgtaacagccgccccgctggctttggcggcacaggcaaacgcagcgttgcccgaaacggcaaaaaacgctttggaagccgcaaaagcggacggtatggaagccggttggattgtagtgggcgttttcgccgcgctttttgtattttccatcgttaagagggtgatgaag

SEQ ID NO: 6818 - protein, 94 aa, Neisseria gonorrhoeae
MFGGRLKNSPSITAKHFLKENIMKFINTCRKYGAKLAVVTAAPLALAAQANAALPETAKNALEAAKADGMEAGWIVVGVFAALFVFSIVKRVMK

SEQ ID NO: 6819 - DNA, 144 bp, Neisseria gonorrhoeae
ttgcgtcggcaattcaggcaaaacgatgaagattaccctcaaaattcttatgggtttggcgtaaaagacgcgccgaagaccgaaattgcttatcccgagacctttacaaaaccgataaatttcaaaattataaaaataaccaat

SEQ ID NO: 6820 - protein, 48 aa, Neisseria gonorrhoeae
LRRQFRQNDEDYPQNSYGFGVKDAPKTEIAYPETFTKPINFKIIKITN

SEQ ID NO: 6821 - DNA, 189 bp, Neisseria gonorrhoeae
cggcgtatgcatctttctccgacaaaccgggatgacgtgcgtgtcctgcaagatcttaaccgcccgctccaaatcatgccgttcttccaaattcaattctttgttgtttaaaatatagtggattaaatttaaatcaggacaaagcgacgaagccgcagacagtacaaatagtacggcaaggcgaggcaa

SEQ ID NO: 6822 - protein, 36 aa, Neisseria gonorrhoeae
RRMHLSPTNRDDVRVLQDLNRPLQIMPFFQIQFFVV

SEQ ID NO: 6823 - DNA, 303 bp, Neisseria gonorrhoeae
atgattactttgacgcattatctggtattgggcgctctcctgttcggtatcagcgcgatgggcatctttatgaaccgcaaaaacgtgctggtattgctgatgtccatcgagctgatgcttttggcggtgaacttcaactttatcgccttctcgcaacatttgggcgatactgccggacaaattttcgtattcttcgtattgaccgttgccgctgccgaatctgccatcggtttggcgattatggtgctggtgtaccgcaaccgacaaacgattaatgttgccgatttggacgagttgaaaggg

SEQ ID NO: 6824 - protein, 101 aa, Neisseria gonorrhoeae
MITLTHYLVLGALLFGISAMGIFMNRKNVLVLLMSIELMLLAVNFNFIAFSQHLGDTAGQIFVFFVLTVAAAESAIGLAIMVLVYRNRQTINVADLDELKG

SEQ ID NO: 6825 - DNA, 168 bp, Neisseria gonorrhoeae
tttacttgagaataaaacatcatccatccttagaatcagatggatgcttctgcccaaaccaagcccgattctaccttttttcggggggcaagccttaggaaagttatggataaaaaatatcctgttttgttcactaaaaaatgccgtctgaaaattcttgaggcacaa

SEQ ID NO: 6826 - protein, 5 aa, Neisseria gonorrhoeae
NIIHP

SEQ ID NO: 6827 - DNA, 132 bp, Neisseria gonorrhoeae
ttgagggtaatcttcatcgttttgcctgaattgccgacgcaaagcgatttatcggcggttgtgtttgagcgtttgattgcagcttgcccaatctcaaatatttctaaataccaattgaaattcaatatttta

SEQ ID NO: 6828 - protein, 44 aa, Neisseria gonorrhoeae
LRVIFIVLPELPTQSDLSAVVFERLIAACPISNISKYQLKFNIL

SEQ ID NO: 6829 - DNA, 669 bp, Neisseria gonorrhoeae
atgactttttccgtgattctgttctatatccttgccgccatcgttttgtacggtgcggttcgtaccgttaccgccaaaaaccctgtccatgccgctttgcatctggtgctgaccttctgcgtgagcgcgatgatttggatgctgatgcaggcggagtttttgggcgtgacgctggtggtggtttacgtcggcgccgtaatggtgttgttcctgttcgtcgtgatgatgctgaatatcgacatcgaggaaatgcgcgccggtttctggcggcacgcgcctgttgccggtgtggtcggtacgttgttggcggttgccctgatcctgattctggtcaacccgaaaaccgacctggccgcatttggtctgatgaaagacattccggccgattacaacaatatccgcgatttgggcagccgtatttataccgactacctgttgccgtttgaattggcggcggtattgctgctgttgggcatggtggccgcgattgcattggttcaccgcaaaaccaccaatccgaaacgtatggatccagccgaccaagttaaagtacgcgccgatcaaggccgtatgcgtctggtgaaaatggaagcggtcaaaccgcaagtcgaatctgccgaagaaagcgaagtttcagacggcctcaagacggaaggggagggcaaagca

SEQ ID NO: 6830 - protein, 223 aa, Neisseria gonorrhoeae
MTFSVILFYILAAIVLYGAVRTVTAKNPVHAALHLVLTFCVSAMIWMLMQAEFLGVTLVVVYVGAVMVLFLFVVMMLNIDIEEMRAGFWRHAPVAGVVGTLLAVALILILVNPKTDLAAFGLMKDIPADYNNIRDLGSRIYTDYLLPFELAAVLLLLGMVAAIALVHRKTTNPKRMDPADQVKVRADQGRMRLVKMEAVKPQVESAEESEVSDGLKTEGEGKA

SEQ ID NO: 6831 - DNA, 180 bp, Neisseria gonorrhoeae
atggatgcttctgcccaaaccaagcccgattctaccttttttcggggggcaagccttaggaaagttatggataaaaaatatcctgttttgttcactaaaaaatgccgtctgaaaattcttgaggcacaaaataagccgatttcaccgaccgcactgttttttgattttgttgttttgcct

SEQ ID NO: 6832 - protein, 60 aa, Neisseria gonorrhoeae
MDASAQTKPDSTFFRGASLRKVMDKKYPVLFTKKCRLKILEAQNKPISPTALFFDFVVLP

SEQ ID NO: 6833 - DNA, 492 bp, Neisseria gonorrhoeae
ttgagggaacataatatggctaacttagtaaaaacctttctgcttggcgaactggtcaaaggcatgggcgtaacgctcaaaaacttttttgcccgcaaagacacaatttattttcccgaagagaaaacgccgcaatccgtgcgtttccgcggtctgcacgcgcaacgccgttatccgaacggagaggaacgctgcatcgcgtgtaaattgtgcgaggcggtgtgtccggcaatggcgatcaacatcgaatcggaagaacgcgaagacggcacccgccgcaccaagcgttacgacatcgacctgaccaagtgcatcttctgcggtttctgcgaagaggcctgcccgaccgatgcgattgtggaaacccatatttttgaataccacggcgagaaaaaaggcgacttgcatatgaccaagcccatcctcttggcaatcggcgacaaatacgaagccgaaatcgccaaacgcaaagccgctgacgcgccgtaccgc

SEQ ID NO: 6834 - protein, 164 aa, Neisseria gonorrhoeae
LREHNMANLVKTFLLGELVKGMGVTLKNFFARKDTIYFPEEKTPQSVRFRGLHAQRRYPNGEERCIACKLCEAVCPAMAINIESEEREDGTRRTKRYDIDLTKCIFCGFCEEACPTDAIVETHIFEYHGEKKGDLHMTKPILLAIGDKYEAEIAKRKAADAPYR

SEQ ID NO: 6835 - DNA, 102 bp, Neisseria gonorrhoeae
ttgaggcacaaaataagccgatttcaccgaccgcactgttttttgattttgttgttttgccttaaatctgtttgccgccgcatattttcagacggcataaca

SEQ ID NO: 6836 - protein, 34 aa, Neisseria gonorrhoeae
LRHKISRFHRPHCFLILLFCLKSVCRRIFSDGIT

SEQ ID NO: 6837 - DNA, 357 bp, Neisseria gonorrhoeae
atgcagcaattattgatttcaatccttgaagatttaaataatacatctacggatattatcgcgtctgccgttatctcaaccgacggattgccgatggcgacaatgcttccttcacatttgaattcggacagggtaggggcgatttctgccactttgcttgctttggggagtcgctcggtgcaggaactcgcctgcggggaattggaacaagtgatgattaaaggaaaatcaggctatatccttttaagtcaggcgggtaaagatgccgtgttggtgctggtggcaaaagaaaccggcagacttggtttaatcctattggatgccaaacgtgcggcaaggcatattgcggaagccata

SEQ ID NO: 6838 - protein, 119 aa, Neisseria gonorrhoeae
MQQLLISILEDLNNTSTDIIASAVISTDGLPMATMLPSHLNSDRVGAISATLLALGSRSVQELACGELEQVMIKGKSGYILLSQAGKDAVLVLVAKETGRLGLILLDAKRAARHIAEAI

SEQ ID NO: 6839 - DNA, 90 bp, Neisseria gonorrhoeae
ccgaccgcactgttttttgattttgttgttttgccttaaatctgtttgccgccgcatattttcagacggcataacataaaaaatccccaa

SEQ ID NO: 6840 - protein, 12 aa, Neisseria gonorrhoeae
PTALFFDFVVLP

SEQ ID NO: 6841 - DNA, 513 bp, Neisseria gonorrhoeae
atgcggacgaagtggtcagcagtgagaagctgctcgcgggcggacaccgccgacatcgataccgctttgaacctgttgtaccgtttgcaaaaactcgaattcctctatggcgatgaaaacggtcattcagacggcatcaatttgtcggacgagcaattgccgttgctgatggaacaattgtccggcagcggtaaggcattattggtcgatcggaacggtctgtatcttgccaacgccaatttccatcatgagtcggcggaagagttggggttgttggcggcagaagtcgcacagatggaaaagaaataccggctgctgattaggaacaacctgtatatcaacaataacgcttggggcgtttgcgatccttccggtcagagcgaattgacatttttcccattgtatatcggttcaaccaaatttattttggttatcgccggcattcccgatttgagcaaagaggcatttgttactttggtaaggattttataccgccgttacagcaaccgcgtg

SEQ ID NO: 6842 - protein, 171 aa, Neisseria gonorrhoeae
MRTKWSAVRSCSRADTADIDTALNLLYRLQKLEFLYGDENGHSDGINLSDEQLPLLMEQLSGSGKALLVDRNGLYLANANFHHESAEELGLLAAEVAQMEKKYRLLIRNNLYINNNAWGVCDPSGQSELTFFPLYIGSTKFILVIAGIPDLSKEAFVTLVRILYRRYSNRV

SEQ ID NO: 6843 - DNA, 1080 bp, Neisseria gonorrhoeae
ttgattatgcaggaatggttccaaaacctctttgccgcaacgctcggtctgggcgatttgggcatcaccgtaggcttggtggtatccgtcatcgtcaaaatcgtgattatcctgattccgctgattctgaccgttgcctacctgacgtatttcgaacgtaaagtcatcggctttatgcagcttcgcgtcggcccgaacgtaaccggcccgcggggtctgattcagccgtttgccgacgtgttcaaactcttgtttaaagaggtaacccgtccgaagctgtcaaacaaagccttattctacatcggcccgattatgtcgctcgccccgtctttcgcggcgtgggcggtgattccgtttaacgaagaatgggtgctgaccaatatcaatatcggccttttgtacatcctgatgattacctcgctgtcggtttacggcgtgattatcgcgggctgggcttccaactccaaatattcgttcttgggtgcaatgcgtgcttccgcgcaaagcatttcctacgagattgccatgagtgccgcgctggtgtgcgttgtgatggtatcgggcagcatgaacttctccgacatcgttgccgcgcaggcaaaaggcatcgcgggcggttctgtgttctcgtggaactggctgccgctgttcccaatcttcatcgtctatctgatttccgccgttgccgaaaccaaccgcgcaccgtttgacgtggcagagggcgagtctgaaatcgttgccggacaccacgtcgaatactccggctttgcattcgcgctgttcttccttgccgaatacattttcatgattctgattgccgcgctgacatcgctgatgttcctcggcggctggttgtctccgttcccgcaaagctggggcattgtcggtacgccttccgcattctggatgttcgtgaaaatggcggcggtgctgtactggtatctgtggattcgtgcaaccttcccacgctaccgctacgaccaaatcatgcgtttgggctggaaagtgctgattccgatcggcttcgcctacatcgtggttttgggcgtgtggatgatttcaccgctgaatttgtggaaa

SEQ ID NO: 6844 - protein, 360 aa, Neisseria gonorrhoeae
LIMQEWFQNLFAATLGLGDLGITVGLVVSVIVKIVIILIPLILTVAYLTYFERKVIGFMQLRVGPNVTGPRGLIQPFADVFKLLFKEVTRPKLSNKALFYIGPIMSLAPSFAAWAVIPFNEEWVLTNINIGLLYILMITSLSVYGVIIAGWASNSKYSFLGAMRASAQSISYEIAMSAALVCVVMVSGSMNFSDIVAAQAKGIAGGSVFSWNWLPLFPIFIVYLISAVAETNRAPFDVAEGESEIVAGHHVEYSGFAFALFFLAEYIFMILIAALTSLMFLGGWLSPFPQSWGIVGTPSAFWMFVKMAAVLYWYLWIRATFPRYRYDQIMRLGWKVLIPIGFAYIVVLGVWMISPLNLWK

SEQ ID NO: 6845 - DNA, 309 bp, Neisseria gonorrhoeae
ttggactttaatttctacatcaacaccggccggcaaatccagcttcatcagcgcatcggtagttttatcggtccaatccacgatgtccatcaggcgcaaatgggtgcggatttccaattgttcacgggaagttttgttcacgtgcggagaacgcaaaatgttgaaacgctcgattttggtcggcaaaggaatcgggccttttacaacagcaccggtacgttttgcagtttcaacgatttcttgtgcagaacggtcaatcagggcgtaatcataagctttcaggcggatacggattttttggtttgccat

SEQ ID NO: 6846 - protein, 103 aa, Neisseria gonorrhoeae
LDFNFYINTGRQIQLHQRIGSFIGPIHDVHQAQMGADFQLFTGSFVHVRRTQNVETLDFGRQRNRAFYNSTGTFCSFNDFLCRTVNQGVIISFQADTDFLVCH

SEQ ID NO: 6847 - DNA, 357 bp, Neisseria gonorrhoeae
ttgcttggggattttcgacagtccgaattattggactttaatttctacatcaacaccggccggcaaatccagcttcatcagcgcatcggtagttttatcggtccaatccacgatgtccatcaggcgcaaatgggtgcggatttccaattgttcacgggaagttttgttcacgtgcggagaacgcaaaatgttgaaacgctcgattttggtcggcaaaggaatcgggccttttacaacagcaccggtacgttttgcagtttcaacgatttcttgtgcagaacggtcaatcagggcgtaatcataagctttcaggcggatacggattttttggtttgccatttatcaatatccttcaat

SEQ ID NO: 6848 - protein, 119 aa, Neisseria gonorrhoeae
LLGDFRQSELLDFNFYINTGRQIQLHQRIGSFIGPIHDVHQAQMGADFQLFTGSFVHVRRTQNVETLDFGRQRNRAFYNSTGTFCSFNDFLCRTVNQGVIISFQADTDFLVCHLSISFN

SEQ ID NO: 6849 - DNA, 366 bp, Neisseria gonorrhoeae
ttggatgaggataccaaagtccatttatatagtacgcccggtcaggaacggttcaactttatgtgggaaatcttaagccaaggcagtatgggtttggtattgcttttagataatgcccgaaccaactcgttgaaagatttggaattctttttacattcgtttcgagggctgctggagaaggcatccgtcgttgtcggtattaccaagatggatatacgctctcagcccggtatcgacgtgtatcacaaatatcttgcaaaacataatcttaatgttccggtttttgaaattgatgcccgtaaggaagatgacgtaaaacaattggttagcgcaatgttattttctattgatccgggactggaggtt

SEQ ID NO: 6850 - protein, 122 aa, Neisseria gonorrhoeae
LDEDTKVHLYSTPGQERFNFMWEILSQGSMGLVLLLDNARTNSLKDLEFFLHSFRGLLEKASVVVGITKMDIRSQPGIDVYHKYLAKHNLNVPVFEIDARKEDDVKQLVSAMLFSIDPGLEV

SEQ ID NO: 6851 - DNA, 2259 bp, Neisseria gonorrhoeae
atgttacaaatcgaaatcgacggcaaacaggtatctgtggagcagggcgcgacggtaattgaagccgcgcacaagctcggtacttatattccgcatttctgttaccacaaaaagctctctattgccgccaactgccgtatgtgtctggtggatgtggaaaaagcccccaaaccgctgcctgcctgtgccacgccggtaacggacggcatgattgtgcgtacgcattcggcaaaagcccgagaggcgcaggaaggcgtgatggagttcctgctcatcaaccatccgcttgattgtccgacctgcgaccagggcggcgaatgccagttgcaggatttggcggtgggctacggcaaaaccaccagccgttataccgaagaaaaacgttccgtcgtcggcaaggacatgggtcctttggtttccgccgaggaaatgagccgctgtatccactgtacccgctgcgtacgtttcaccgaagaaatcgccggtttgcaggaaattgcgatggtgaatcgtggtgaacactccgaaatcatgccctttatcggcaaagcggtggaaaccgagctgtcgggcaacgtcatcgatttgtgtcccgtcggcgcattgaccagcaaaccgttccgcttcaacgcgcgtacttgggaattgaaccgccgcaaatccgtttccgcacacgacgctttgggcagcaacctgattgtacaaaccaaagaccataccgtccgccgcgtgttgccgttggaaaacgaagccatcaacgaatgctggctgtccgaccgcgaccgttttgcctacgaaggcctgtatcacgaaagccgtctgaaaaatccgaaaatcaaacagggtggcgagtggatggacgtggattggaaaaccgcgttggaatatgtccgcagcgcgattgaatgtatcgccaaagacggcaaccaaaaccaagtcggcgtttgggctaatccgatgaatacggttgaagagctgtatctggccaaaaaatttgccgacggcttgggtgttaaaaactttgcaacccgtttgcgccaacaagacaaacgtctttcagacggccttaaaggtgcgcaatggttgggacaaagtattgaatctttggctgacaacgatgccgtattggtagtcggtgcgaacttgcgcaaagaacagccgctcctgaccgcccgcctgcgccgcgccgccaaagaccgtatggccttgagcgtattggccggcagtaaagaagaattgtttatgccgcttctgtctcaagaagccgcacatcccgacgagtgggcaggccgtctgaaaaacctgtctgccgatgcggaacatgccgttaccgccagcctgaaaaacgctgaaaaagcagcggtgattttgggtgcggaagtgcaaaaccatcctgattacgccgccatttatgccgccgcgcaagagttggcggacgcgaccggcgcagtgctgggcattttgccgcaagccgccaacagcgtcggtgcggacgtattgggtgtgaactcgggcgagagcgttgccgaaatggcaaacacgccgaaacaggcagtcttgctgctcaacgtcgagcctgaaatcgatacggttgacggtgcaaaagccgtagccgcgttgaaacaggcgaaaagcgtgatggcgtttacgccgtttgtcagcgaaacgctgctggacgtgtgcgacgtattgctgccgattgcgccgtttaccgaaacatcaggcagcttcatcaatatggaaggccgtctgcaatctttccacggcgtggtacaaggcttcggcgattcacgtccgatgtggaaagtgttgcgcgtattgggcaacctgtttgacctgaaaggttttgaataccacgataccgctgcgattctgaaagacgcgctggatgcggaaagtctgccgtccaaactggacaaccgcagcacatgggcaggggagggcgttcagacggcctcaaaccgcctcgtccgtgtcggcggcgtcggtatttatcatactgattctatcgtgcgccgttccgcaccgttgcaagaaaccagccatgccgccgtgcctgccgcgcgtgtgaatccgaacacattggcacgcttgggcctgcaagacggacaaaccgctgtcgccaaacaaaacggtgcaagcgtatcggttgccgtcaaagccgatgccggtttgcctgaaaacgtggtgcatctgccgctgcataccgaaaatgccgcgctgggtgcgttgatgggcattattgaactggcgggagct

SEQ ID NO: 6852 - protein, 753 aa, Neisseria gonorrhoeae
MLQIEIDGKQVSVEQGATVIEAAHKLGTYIPHFCYHKKLSIAANCRMCLVDVEKAPKPLPACATPVTDGMIVRTHSAKAREAQEGVMEFLLINHPLDCPTCDQGGECQLQDLAVGYGKTTSRYTEEKRSVVGKDMGPLVSAEEMSRCIHCTRCVRFTEEIAGLQEIAMVNRGEHSEIMPFIGKAVETELSGNVIDLCPVGALTSKPFRFNARTWELNRRKSVSAHDALGSNLIVQTKDHTVRRVLPLENEAINECWLSDRDRFAYEGLYHESRLKNPKIKQGGEWMDVDWKTALEYVRSAIECIAKDGNQNQVGVWANPMNTVEELYLAKKFADGLGVKNFATRLRQQDKRLSDGLKGAQWLGQSIESLADNDAVLVVGANLRKEQPLLTARLRRAAKDRMALSVLAGSKEELFMPLLSQEAAHPDEWAGRLKNLSADAEHAVTASLKNAEKAAVILGAEVQNHPDYAAIYAAAQELADATGAVLGILPQAANSVGADVLGVNSGESVAEMANTPKQAVLLLNVEPEIDTVDGAKAVAALKQAKSVMAFTPFVSETLLDVCDVLLPIAPFTETSGSFINMEGRLQSFHGVVQGFGDSRPMWKVLRVLGNLFDLKGFEYHDTAAILKDALDAESLPSKLDNRSTWAGEGVQTASNRLVRVGGVGIYHTDSIVRRSAPLQETSHAAVPAARVNPNTLARLGLQDGQTAVAKQNGASVSVAVKADAGLPENVVHLPLHTENAALGALMGIIELAGA

SEQ ID NO: 6853 - DNA, 567 bp, Neisseria gonorrhoeae
ttgccatttatcaatatccttcaattaagcgataacagaagaaaccacgccggcacccacggtacggccgccttcgcgaatcgcaaagcgcagaccttcttccatagcgataggcgcaatcagttctacagtaatggttacgttctcacccggcattaccatttccacacctttttccaaagtaaccgcgccggttacgtcagtggtacggaagtagaattggggacggtagttggcgaaaaacggggtatggcggccgccctcttctttgctcaatacgtacacttctgctttgaacttggtgtgaggagtgatagtacccggtttggccaatacctgaccgcgttctacgtcttcacgtttggtaccgcgcagcaatacgcctacgttgtcgcccgcctgaccttcgtccagcagtttgcggaacatttcaacgccggtacaggtggttttttgggtttctttcagaccgacgatttcaatctcgtcaccaacgtggatgatacctcgctctacacggccggtgactacggtaccgcggccggaaaatggagaacacgtcttcga

SEQ ID NO: 6854 - protein, 189 aa, Neisseria gonorrhoeae
LPFINILQLSDNRRNHAGTHGTAAFANRKAQTFFHSDRRNQFYSNGYVLTRHYHFHTFFQSNRAGYVSGTEVELGTVVGEKRGMAAALFFAQYVHFCFELGVRSDSTRFGQYLTAFYVFTFGTAQQYAYVVARLTFVQQFAEHFNAGTGGFLGFFQTDDFNLVTNVDDTSLYTAGDYGTAAGKWRTRLR

SEQ ID NO: 6855 - DNA, 174 bp, Neisseria gonorrhoeae; identical to SEQ ID NO: 3261

SEQ ID NO: 6856 - protein, 58 aa, Neisseria gonorrhoeae; identical to SEQ ID NO: 3262

SEQ ID NO: 6857 - DNA, 90 bp, Neisseria gonorrhoeae
atgaataaaaaccaatcctctgaccttcatgatcaaatactgcaacaaaatctaagccgtttccatatctttcaaaaaagactagaaatt

SEQ ID NO: 6858 - protein, 30 aa, Neisseria gonorrhoeae
MNKNQSSDLHDQILQQNLSRFHIFQKRLEI

SEQ ID NO: 6859 - DNA, 402 bp, Neisseria gonorrhoeae
agcgataacagaagaaaccacgccggcacccacggtacggccgccttcgcgaatcgcaaagcgcagaccttcttccatagcgataggcgcaatcagttctacagtaatggttacgttctcacccggcattaccatttccacacctttttccaaagtaaccgcgccggttacgtcagtggtacggaagtagaattggggacggtagttggcgaaaaacggggtatggcggccgccctcttctttgctcaatacgtacacttctgctttgaacttggtgtgaggagtgatagtacccggtttggccaatacctgaccgcgttctacgtcttcacgtttggtaccgcgcagcaatacgcctacgttgtcgcccgcctgaccttcgtccagcagtttgcggaacat

SEQ ID NO: 6860 - protein, 134 aa, Neisseria gonorrhoeae
SDNRRNHAGTHGTAAFANRKAQTFFHSDRRNQFYSNGYVLTRHYHFHTFFQSNRAGYVSGTEVELGTVVGEKRGMAAALFFAQYVHFCFELGVRSDSTRFGQYLTAFYVFTFGTAQQYAYVVARLTFVQQFAEH

SEQ ID NO: 6861 - DNA, 285 bp, Neisseria gonorrhoeae
ttgaccaaggcatccgtcaaccttaacgtgttgtataaagtgatgcctttaaacctcaatgatattctgaattatcttgcggcaacctatacaaccgggtttttgtcggtagatttgaaaacggtttcacaacaggcatactccgatatggcggataaaataaatatcggggccgattctgcttctgatagtgaaatgatgaaaaaagcggaaaaaatcacgacaccatcccaatcccagtcgcgcggccttctgcaaagactgatgaaaaaactgttgggcagc

SEQ ID NO: 6862 - protein, 95 aa, Neisseria gonorrhoeae
LTKASVNLNVLYKVMPLNLNDILNYLAATYTTGFLSVDLKTVSQQAYSDMADKINIGADSASDSEMMKKAEKITTPSQSQSRGLLQRLMKKLLGS

SEQ ID NO: 6863 - DNA, 657 bp, Neisseria gonorrhoeae
gtggttttttgggtttctttcagaccgacgatttcaatctcgtcaccaacgtggatgatacctcgctctacacggccggtgactacggtaccgcggccggaaaatggagaacacgtcttcgataggcagcaggaatggtttgtccacggcacgctcgggagtcgggatgtagctgtccaatgcggtagccagttcgaagattttttcttcgtaagcggcatcgccttccaaggctttcagtgcggaaccttgtacgatcgggcagtcgtcgccggggaagtcgtagctggacagcaggtcgcggatttccatttcaaccagttccaacagctcggcatcgtcgaccatgtcgcatttgttcatgaacacgatgatgtaaggtacgcctacttgacgggccagcaggatgtgttcgcgggtttgcggcatagggccgtcggcagcagaacataccaggattgcaccgtccatttgtgcggcgccggtaatcatgtttttaacgtagtcggcgtgacccggacagtctacgtgtgcgtagtggcgggtttcggtttcgtattctacgtgcgaggtgttaatggtaataccgcgtgctttttcttcgggtgcgttgtcgatttggtcgtaagcttttgcagcgccgccgaattttttagc

SEQ ID NO: 6864 - protein, 219 aa, Neisseria gonorrhoeae
VVFWVSFRPTISISSPTWMIPRSTRPVTTVPRPENGEHVFDRQQEWFVHGTLGSRDVAVQCGSQFEDFFFVSGIAFQGFQCGTLYDRAVVAGEVVAGQQVADFHFNQFQQLGIVDHVAFVHEHDDVRYAYLTGQQDVFAGLRHRAVGSRTYQDCTVHLCGAGNHVFNVVGVTRTVYVCVVAGFGFVFYVRGVNGNTACFFFGCVVDLVVSFCSAAEFFS

SEQ ID NO: 6865 - DNA, 312 bp, Neisseria gonorrhoeae
gtggggagggtggtaatggtggaagctaaaatttttattctatacggtgcagccaacaaaggtaagagtacgacactcaatacgctttttaatcagatttgtcggaaattttctaaatttctagtcttttttgaaagatatggaaacggcttagattttgttgcagtatttgatcatgaaggtcagaggattggtttttattcatctggtgataatgaatacgaggttaggagaaatttatacaaactttattcgcataattgtgattttattttggcacgtcaaggacacggggtggtagttgcgatgcag

SEQ ID NO: 6866 - protein, 104 aa, Neisseria gonorrhoeae
VGRVVMVEAKIFILYGAANKGKSTTLNTLFNQICRKFSKFLVFFERYGNGLDFVAVFDHEGQRIGFYSSGDNEYEVRRNLYKLYSHNCDFILARQGHGVVVAMQ

SEQ ID NO: 6867 - DNA, 726 bp, Neisseria gonorrhoeae
atggcaggccatagcaagtgggcgaatatccagcataaaaaagcccgtcaggatgccaaacgcggcaaaatcttcacccgtttaatcaaagaaatcaccgttgcggcgcgtatgggcggcggcgatcccggcgcaaatccgcgcctgcgtctggctttggaaaaagcagccgaaaacaatatgcccaaagacaatgtgcaacgcgccatcgacaaaggtacgggtaacttggaaggcgtggaatacatcgagttgcgctacgaaggctacggcatcggcggcgcagctttgatggtggactgcctgaccgacaacaaaacccgcaccgttgcggacgtacgccacgcatttaccaaaaacggcggcaacttgggtaccgacggctgcgtggcgttcaacttcgtgcatcagggctatttggtattcgaacccggcgttgacgaagacgagctgatggaagcggctttggaagccggtgcggaagacgtggttaccaacgacgacggttccatcgaagtcattaccgcgccaaatgattgggcgggcgtaaaatccgctttggaggcggcaggttacaaatccgttgacggcgacgttacgatgcgcgcccaaaacgaaaccgaactctccggcgacgatgccgtcaaaatgcaaaaactgattgacgcgctggaagacttggacgacgtgcaagacgtttacacttccgccgtattgaatctggac

SEQ ID NO: 6868 - protein, 242 aa, Neisseria gonorrhoeae
MAGHSKWANIQHKKARQDAKRGKIFTRLIKEITVAARMGGGDPGANPRLRLALEKAAENNMPKDNVQRAIDKGTGNLEGVEYIELRYEGYGIGGAALMVDCLTDNKTRTVADVRHAFTKNGGNLGTDGCVAFNFVHQGYLVFEPGVDEDELMEAALEAGAEDVVTNDDGSIEVITAPNDWAGVKSALEAAGYKSVDGDVTMRAQNETELSGDDAVKMQKLIDALEDLDDVQDVYTSAVLNLD

SEQ ID NO: 6869 - DNA, 1206 bp, Neisseria gonorrhoeae
aacttcgattttattcggcgtaaacgtctgccatttgttgcaggcgggacagtgccagaaaaagacttgggatttgaagtggcagttgcggcaacggtacatcacgctgcgctggagctgccgtccgataaccgaacgcatcatgtcggcatcggctttccaagccggatccaaatcgctgagtttcaaaccgagcaggcggtacacgccgttaaggtcgggcttgcggcggacaagctcgacggcggtttgcgcggcttctttctcgcccttaagcagcagggatttctcgtacacgacattgatcaggtcaagttcgggaaacgtctgcatatatcctgtcagacggttcaagccttcttcaggttttccctgcgcggcataggcttcgtaaagcttctcgccgaccatgctcaagtatgcatggttttgctgctcgatggcggcataggcttcgacggcggcagggaaattgccttgtcggtgttcaatgtcgcccaaaatcatgttggcgcgggtgcattttttgttggcttcgagtgccttgccgacattgaaacgcgcggcatcgaaattggacttgaacagcgcggcttgggcaagttcgcaataaaactgtgcaatctcaaactgatatgtctgttcgtcgtgactaagaagttgggcggtttcaaccgctttttcccaatccctgtcctgctggtagatattgagcaggtgctgtctggcttcacgcgccatttcaccgtcttgcagccccaaaaaaatctgttcggcacgatcgaccaaacccgcgctttggtagttttgcgccaattcaaacaggacgcgcgcgcgcttttcgccgaccgtatcgggagaatcgagcattgtccggtgtatgttgatggctttgtcgttttcgccgcgctgacggtaaagtttgccgagggtaaggttcaaatcatacgattgcggccggccgtcgacgacttccgccaactcccttgccgcgcgcccgctgttgcggtcgaccaaagcgtccaggcttttataaaatcccgaagggatgctttttgcctgcttcaatacggttttcatatccacgcgggcggcaaaccagcccatcgtgaagaagacgggcaaaaggataatcggcagcaggataatccacaattcgttgtccatatcggctttcttaaggctgtttggcagattcggcagcat

SEQ ID NO: 6870 - protein, 402 aa, Neisseria gonorrhoeae
NFDFIRRKRLPFVAGGTVPEKDLGFEVAVAATVHHAALELPSDNRTHHVGIGFPSRIQIAEFQTEQAVHAVKVGLAADKLDGGLRGFFLALKQQGFLVHDIDQVKFGKRLHISCQTVQAFFRFSLRGIGFVKLLADHAQVCMVLLLDGGIGFDGGREIALSVFNVAQNHVGAGAFFVGFECLADIETRGIEIGLEQRGLGKFAIKLCNLKLICLFVVTKKLGGFNRFFPIPVLLVDIEQVLSGFTRHFTVLQPQKNLFGTIDQTRALVVLRQFKQDARALFADRIGRIEHCPVYVDGFVVFAALTVKFAEGKVQIIRLRPAVDDFRQLPCRAPAVAVDQSVQAFIKSRRDAFCLLQYGFHIHAGGKPAHREEDGQKDNRQQDNPQFVVHIGFLKAVWQIRQH

SEQ ID NO: 6871 - DNA, 720 bp, Neisseria gonorrhoeae
ccaacgtggatgatacctcgctctacacggccggtgactacggtaccgcggccggaaaatggagaacacgtcttcgataggcagcaggaatggtttgtccacggcacgctcgggagtcgggatgtagctgtccaatgcggtagccagttcgaagattttttcttcgtaagcggcatcgccttccaaggctttcagtgcggaaccttgtacgatcgggcagtcgtcgccggggaagtcgtagctggacagcaggtcgcggatttccatttcaaccagttccaacagctcggcatcgtcgaccatgtcgcatttgttcatgaacacgatgatgtaaggtacgcctacttgacgggccagcaggatgtgttcgcgggtttgcggcatagggccgtcggcagcagaacataccaggattgcaccgtccatttgtgcggcgccggtaatcatgtttttaacgtagtcggcgtgacccggacagtctacgtgtgcgtagtggcgggtttcggtttcgtattctacgtgcgaggtgttaatggtaataccgcgtgctttttcttcgggtgcgttgtcgatttggtcgtaagcttttgcagcgccgccgaattttttagctaaaatagtagtcaaagcagcagtcagggtggttttaccatggtcaacgtgaccgatggtgccaacgtttacgtgcggtttgctacgttcgaatttttccttagccat

SEQ ID NO: 6872 - protein, 204 aa, Neisseria gonorrhoeae
PTWMIPRSTRPVTTVPRPENGEHVFDRQQEWFVHGTLGSRDVAVQCGSQFEDFFFVSGIAFQGFQCGTLYDRAVVAGEVVAGQQVADFHFNQFQQLGIVDHVAFVHEHDDVRYAYLTGQQDVFAGLRHRAVGSRTYQDCTVHLCGAGNHVFNVVGVTRTVYVCVVAGFGFVFYVRGVNGNTACFFFGCVVDLVVSFCSAAEFFS

SEQ ID NO: 6873 - DNA, 159 bp, Neisseria gonorrhoeae
gtggcagttttccatttggacggcgcaggacaggttgatttatccgatttttcccgatactccgtttacgttgaaatcttggccaaacctgacccggtaggcaaatgtgccggggtcgatacgcttgtcggcatttttgaccaaggcatccgtcaacct

SEQ ID NO: 6874 - protein, 53 aa, Neisseria gonorrhoeae
VAVFHLDGAGQVDLSDFSRYSVYVEILAKPDPVGKCAGVDTLVGIFDQGIRQP

SEQ ID NO: 6875 - DNA, 1299 bp, Neisseria gonorrhoeae
atggctatttaccaatcaggcgtgatttttgaccaagtggataccgccaatcccgattgctggacattggacgaatacgtcaaacgcggcggctataccgccctgcgtaaaatcctgtccgaaaacatctcgcaaaccgatgtgattgacgaagtcaaaacctccggcttgcgcgggcgcggcggtgcgggcttcccgaccggtttgaaatggagctttatgccccgttctttcccgggcgaaaaatatgtggtttgcaacaccgacgaaggcgagccgggtacatttaaagaccgcgacatcatcatgttcaatcctcatgccctgattgaaggcatgatcattgccggttacgcgatgggcgcgaaagccggctacaactatatccacggcgaaattttcgaaggttatcaacgctttgaagccgctttggagcaggcgcgtgccgcaggctttttgggtaaaaatattttgggttcggattttgaattcgaactcttcgcccaccacggctacggcgcatatatttgcggcgaagaaaccgcattgcttgaatcgttggaaggcaaaaaaggccagccgcgcttcaaaccgccgttccccgcctcgttcggcctgtacggcaaaccgaccaccatcaacaataccgaaacgttctcctccgtcccgtttattatccgtgacggcggacaggcgtttgccgataaaggtattccgaatgcaggcggtaccaaattattttgtatttccggccatgtcgagcgtccgggcaactatgaagtgccgttgggcacgccgtttgccgaagtcttgaaaatggcgggcggtatgcgcggcggtaaaaaactcaaagccgttattcccggcggttcgtccgcccccgtattgcctgccgacattatgatgcagaccaatatggactatgactcgatttccaaagccggctcgatgctcggttccggcgcgattatcgtgatggacgaagacgtgtgcatggtcaaagccctcgaacgcttaagctatttctactacgacgaatcctgcggccaatgcaccccctgccgcgaaggtaccggctggctttaccgcatcgtccgccgcatcgtagaaggcaaaggccgcatggaagacttggatttgctggattctgtcggcaaccaaatggcaggccgcaccatctgcgcccttgccgatgccgccgtcttccctgtccgcagctttaccaagcatttccgtgatgagtttgcgcattacatcgaacacggcgggccgatgaaagagcataagtggggagggtgg

SEQ ID NO: 6876 - protein, 433 aa, Neisseria gonorrhoeae
MAIYQSGVIFDQVDTANPDCWTLDEYVKRGGYTALRKILSENISQTDVIDEVKTSGLRGRGGAGFPTGLKWSFMPRSFPGEKYVVCNTDEGEPGTFKDRDIIMFNPHALIEGMIIAGYAMGAKAGYNYIHGEIFEGYQRFEAALEQARAAGFLGKNILGSDFEFELFAHHGYGAYICGEETALLESLEGKKGQPRFKPPFPASFGLYGKPTTINNTETFSSVPFIIRDGGQAFADKGIPNAGGTKLFCISGHVERPGNYEVPLGTPFAEVLKMAGGMRGGKKLKAVIPGGSSAPVLPADIMMQTNMDYDSISKAGSMLGSGAIIVMDEDVCMVKALERLSYFYYDESCGQCTPCREGTGWLYRIVRRIVEGKGRMEDLDLLDSVGNQMAGRTICALADAAVFPVRSFTKHFRDEFAHYIEHGGPMKEHKWGGW

SEQ ID NO: 6877 - DNA, 165 bp, Neisseria gonorrhoeae; identical to SEQ ID NO: 3321

SEQ ID NO: 6878 - protein, 55 aa, Neisseria gonorrhoeae; identical to SEQ ID NO: 3322

SEQ ID NO: 6879 - DNA, 2103 bp, Neisseria gonorrhoeae
gcctttacgggcttcagttacagcagcagctatgtgggcaggagcttcagaatatttcttgaactccatagagtaagtagcgcggccttgggttgcagaacgcaggtcggtcgagtaaccgaacatttctgccagaggtacttcggcacggacttttttaccgccgataccgtcatcatccatacccaatacaacaccgcgacggcggttcaagtcgcccattacgtcgcccatgtattcttccggagtttccacttcaactgccataatcggctcaagcagggcaggagatgcttgacgcataccttctttaaacgcttgagaagcagccaattcaaatgccaattgggaagagtcgacatcatggtaagaaccgaataccagacggatacgtacgtcaactacaggatagccggcaacgataccgttaggcaacgtatcgcggatacctttatcgacagacggaataaattcgcgaggaatcacaccacctttaatttcatcgataaactcgtaaccttcaccacccggttccataggttccatttcaatcacaacgtgaccgtattgacctttaccaccggattgttttgcatgtttgtattcagctttaacggctttgcggatagtttcacggtaagccacttgaggtgcaccgatatttgcttccacaccgaattcgcgtttcatacggtcaacaataatttccaagtgcagctcacccataccggaaataatggtttgaccggattcttcgtctgtacgaacgcggaaagaagggtcttctttagccaagcggttcagggcgatacccattttctcttggtcggctttggttttcggctcaacggcaatatggattaccggctcggggaattccatacgttccaagataatcggcgcgctttccgcacacaaggtttcaccggtagtaacgtctttcagaccgatagcggctgcgatgtcgccagcgcgtacttcttcgatttcagtacggtctgcggcagtcatttgcaccaaacgaccgatacgttcgcgagtgccttttacagaattcagtacggtatcgccggattttactacgcctgagtaaacgcggataaaggtcagctgaccgacgtatttgtcgttcaacattttgaatgccaatgcagagaatttctcttcatcgctggcttgacggctgtcggcttcttcagtgttaggattaacaccttgaaccggaggaatatcggtaggagctggcagcaattctacaactgcgtccaacatacgttgaacacctttgtttttaaatgcagaaccgcacagcataggctgaatttcgcctgccaaagtacgttgacgcaacgcgcctacgatttcttcttcggccagatcttcaccgcccaagtatttgtccatcagttcttcgctggcttcggctgcggcttcaatcatattttgacgccattcttcggcagtttcgaccaattcggcaggaatatcgccataggtaaaggttgtacctttatcggcttcattccagatgatagatttcattttcagcaaatcgacaacaccggtaaaactgtcttccgcgcctaccggaatgacgataggtacggggtttgcgcgcaaacgggttttcatttgctcgacaacgcggaagaagttggcaccttggcggtccattttattgacaaacgccaagcgcggaacttggtatttgttggcttgccgccatacggtttcagattgcggttgaacaccgcccaccgcacagtaaaccattaccgcgccgtccaatacacgcatagaacgctctacctctacggtaaagtcaacgtgccccggggtgtcgatgatgttgaagcggtgctcggggaattgtttcgccataccggaccagtaggaagtaacggcagcggaggtaatggtaataccgcgctcttgctcttgttccatgtagtcggtagtagccgcaccgtcatgcacttcgcccagcttgtgggtcaaaccggtatagaacaaaatacgttctgtcgtcgtggttttacccgcatcgatatgggcggaaataccgatgttgcggtacaggctgatcggggtcttacgagccat

SEQ ID NO: 6880 - protein, 362 aa, Neisseria gonorrhoeae
AFTGFSYSSSYVGRSFRIFLELHRVSSAALGCRTQVGRVTEHFCQRYFGTDFFTADTVIIHTQYNTATAVQVAHYVAHVFFRSFHFNCHNRLKQGRRCLTHTFFKRLRSSQFKCQLGRVDIMVRTEYQTDTYVNYRIAGNDTVRQRIADTFIDRRNKFARNHTTFNFIDKLVTFTTRFHRFHFNHNVTVLTFTTGLFCMFVFSFNGFADSFTVSHLRCTDICFHTEFAFHTVNNNFQVQLTHTGNNGLTGFFVCTNAERRVFFSQAVQGDTHFLLVGFGFRLNGNMDYRLGEFHTFQDNRRAFRTQGFTGSNVFQTDSGCDVASAYFFDFSTVCGSHLHQTTDTFASAFYRIQYGIAGFYYA

SEQ ID NO: 6881 - DNA, 174 bp, Neisseria gonorrhoeae
ttgcaggtcagttgcaagactgttcccgataactcgcaatggcgcgaaaaggctaaagtaggcattatgtcctgtatgtggcagttttccatttggacggcgcaggacaggttgatttatccgatttttcccgatactccgtttacgttgaaatcttggccaaacctgacccgg

SEQ ID NO: 6882 - protein, 58 aa, Neisseria gonorrhoeae
LQVSCKTVPDNSQWREKAKVGIMSCMWQFSIWTAQDRLIYPIFPDTPFTLKSWPNLTR

SEQ ID NO: 6883 - DNA, 168 bp, Neisseria gonorrhoeae
ttgcaactgacctgcaaattttcgtctttgcacaattcttcgagtttttacacactttctgtcagcaaaacccgttgtatcgaggggaaaacaattaaggaccggcttatttccatgcaagatagcgatgtcctgcctgttcttttccgcaaaccgcaacgcccccaa

SEQ ID NO: 6884 - protein, 56 aa, Neisseria gonorrhoeae
LQLTCKFSSLHNSSSFYTLSVSKTRCIEGKTIKDRLISMQDSDVLPVLFRKPQRPQ

SEQ ID NO: 6885 - DNA, 471 bp, Neisseria gonorrhoeae
atgttatccgcaaaatccttaaaacaaatcgacattgagttggcgaaatatcccgccgaccaacgccgttccgccatcatgggcgcgttgcgtatcgcccaaaccgaaaaaggctggctcgcccccgaaaccatcgcttttgttgccgactacatcggcatcacgccggcgcaggcatatgaagtcgccactttctacaatatgtacgaccttgagcctgtcggcaaatacaaactgaccgtttgtaccaacctgccctgcgctctgcgcggcggtatggcgaccggcgaatacctcaaacaaaaactcggtatcggctacggcgaaaccacgcccgacggcaaatttacccttgtcgaaggcgaatgcatgggcgcgtgcggcgatgcccccgttatgctggtcaacaaccacagcatgtgcagctttatgaccgaagaggcgattgagaagaaactggcggagttggag

SEQ ID NO: 6886 - protein, 157 aa, Neisseria gonorrhoeae
MLSAKSLKQIDIELAKYPADQRRSAIMGALRIAQTEKGWLAPETIAFVADYIGITPAQAYEVATFYNMYDLEPVGKYKLTVCTNLPCALRGGMATGEYLKQKLGIGYGETTPDGKFTLVEGECMGACGDAPVMLVNNHSMCSFMTEEAIEKKLAELE

SEQ ID NO: 6887 - DNA, 468 bp, Neisseria gonorrhoeae
gaaacggaagtgagagaatgctttgttggcttcagccatacggtgtacttcttcacgttttttcaacgcaccgccacggccttcggacgcatcaatcaactcgcctgccaaacgcagatccatggatttctcaccacgtttgcgggccgcgtcgcgaacccaacgcattgccaaagccagacggcgtgaaggacgaacttcaacaggaacttggtagtttgcaccacctacacggcggcttttcacttccacgataggtttggagtttgcaatggcttcgttaaatacttcgattgctgctttgccggtttttttctcaatctgttccaacgcaccgtaaacgatacgctcggcaacggattttttaccgtcaatcatcaatacgttcatgaatttggtcaactcgacgctaccgaatttaggatctggcagtacgtcgcgcttggggacttctctacgtcttggcat

SEQ ID NO: 6888 - protein, 62 aa, Neisseria gonorrhoeae
ETEVRECFVGFSHTVYFFTFFQRTATAFGRINQLACQTQIHGFLTTFAGRVANPTHCQSQTA

SEQ ID NO: 6889 - DNA, 627 bp, Neisseria gonorrhoeae
atggaagttcaactgccgaaaattaaaacagtacgcgtaatgttggcggggatgacggcgcagcaggaatccgttttcaaaatggcattcaaaatgcacaataccacccgttatgaaacagtatccccttcagacggcagtgccgtgcccgatttggttttggcggataccgatgccgagggcggttttgaactttggaaagagcttgccgggcgttataaggctatacccgtcgccgtctgttcggagaaagttcccgattctgaagttccctacctgcccaaaccgattcggtttgaaacattgtttcctatgctccgcaagttattgcagggcgagaatgtttatgggaaatcgtttattgcacccgcagaccggtcggcgaaaaacaacgggaatgtgcagcgtacggttacgatacgccagtttaacccgaataaaggattattgggggcgttgcggtttgcggaaaagaacaggcaggacatcgctatcttgcatggaaataagccggtccttaattgttttcccctcgatacaacgggttttgctgacagaaagtgtgtaaaaactcgaagaattgtgcaaagacgaaaatttgcaggtcagttgcaagactgttcccga

SEQ ID NO: 6890 - protein, 209 aa, Neisseria gonorrhoeae
MEVQLPKIKTVRVMLAGMTAQQESVFKMAFKMHNTTRYETVSPSDGSAVPDLVLADTDAEGGFELWKELAGRYKAIPVAVCSEKVPDSEVPYLPKPIRFETLFPMLRKLLQGENVYGKSFIAPADRSAKNNGNVQRTVTIRQFNPNKGLLGALRFAEKNRQDIAILHGNKPVLNCFPLDTTGFADRKCVKTRRIVQRRKFAGQLQDCSR

SEQ ID NO: 6891 - DNA, 369 bp, Neisseria gonorrhoeae
tttaggacgcttagcaccgtatttagaacgggcttgtttgcggtctttaacacctgcagtatccaaagaaccgcgtacagtgtggtaacgtacacccggcaagtcttttacacggccgccgcgaatcagtacgacgctgtgctcttgcaggttgtggccttcaccgccgatatatgaaatgacttcaaaaccgttggtcaggcggactttacatactttacgcaatgcagagttaggttttctaggggtagtcgtgtatacacgggtgcacacgccgcgtttttgcgggcaggcttccagtgcgggcactttgtttacgtacacgggcttttgacggcctttgcgtaccaattggttgatagttggcat

SEQ ID NO: 6892 - protein, 58 aa, Neisseria gonorrhoeae
FRTLSTVFRTGLFAVFNTCSIQRTAYSVVTYTRQVFYTAAANQYDAVLLQVVAFTADI

SEQ ID NO: 6893 - DNA, 1302 bp, Neisseria gonorrhoeae
ttgagccgcgcgaaatcacaccgcgtatcgtccgtgaggagaactacggtggccaataaattaagaaactacaccatcaacttcggcccgcagcaccctgcggcgcatggcgtattgcgtatgattttggagctggacggcgaacaaatcgtccgtgccgatccgcatatcggcctcctgcaccggggcaccgaaaaactggcggaaaccaaaacctatctgcaagccctgccctatatggaccgtttggactacgtttccatgatggtcaacgagcaggcgtattgcttggcggtagaaaaacttgccggtatcgatgtgcctatccgcgcccaatacatccgcgtgatgttcgccgaagtaacgcgcatcctcaatcacttgatgggcatcggttcgcacgccttcgacatcggcgcgatgaccgccatcctctacgccttccgcgaccgcgaagagctgatggacttgtacgaagccgtgtccggcgcacgtatgcacgccgcctacttccgtcccggcggcgtttaccgcgacctacccggctttatgcccaaatacgagagcagcaaatttcgcaatgccaaagtattgaagcagctcaacgaatcccgcgaaggcacgatgcttgactttatcgatgccttctgcgaacgcttccccaaaaatatcgacacactcgaaaccctcctgaccgacaaccgcatctggaaacagcgtaccgtcggcatcggcgttgtctctcccgagcgcgccatgcaaaaaggctttaccggtgtgatgcttcgcggttccggcgtggaatgggacgtgcgtaagacacagccctacgaagtgtacgacaaaatggatttcgacatccccgtcggcgtcaacggcgactgctacgaccgttacctctgccgtatggaagaaatgcgccaatccgtacgcatcatcaaacaatgcgccgactggttgcgcgtcaatcccggcccggtcattaccgcaaaccacaaattcgctccgcccaaacgtaccgaaatgaaaacaggtatggaagacctgattcaccatttcaaactctttaccgagggtatgcacgttcccgagggcgagacctacaccgctgtcgaacacccgaaaggcgagttcggcgtttacatcatttcagacggcgcaaacaaaccctaccgcctgaaaatccgcgcacccggcttcgcccacctgcaaggcatggacgaaatggcaaaaggccatatgctcgccgacgtcgttgccatcatcggtacgcaggacatcgtattcggggaggttgaccga

SEQ ID NO: 6894 - protein, 434 aa, Neisseria gonorrhoeae
LSRAKSHRVSSVRRTTVANKLRNYTINFGPQHPAAHGVLRMILELDGEQIVRADPHIGLLHRGTEKLAETKTYLQALPYMDRLDYVSMMVNEQAYCLAVEKLAGIDVPIRAQYIRVMFAEVTRILNHLMGIGSHAFDIGAMTAILYAFRDREELMDLYEAVSGARMHAAYFRPGGVYRDLPGFMPKYESSKFRNAKVLKQLNESREGTMLDFIDAFCERFPKNIDTLETLLTDNRIWKQRTVGIGVVSPERAMQKGFTGVMLRGSGVEWDVRKTQPYEVYDKMDFDIPVGVNGDCYDRYLCRMEEMRQSVRIIKQCADWLRVNPGPVITANHKFAPPKRTEMKTGMEDLIHHFKLFTEGMHVPEGETYTAVEHPKGEFGVYIISDGANKPYRLKIRAPGFAHLQGMDEMAKGHMLADVVAIIGTQDIVFGEVDR

SEQ ID NO: 6895 - DNA, 117 bp, Neisseria gonorrhoeae
ttgcgtaccaattggttgatagttggcatattttctcgtcctgttgagttaaatatttgccgacaccatgtcggcaagagcggaattatatttttattgcaagcagacagtcaagca

SEQ ID NO: 6896 - protein, 39 aa, Neisseria gonorrhoeae
LRTNWLIVGIFSRPVELNICRHHVGKSGIIFLLQADSQA

SEQ ID NO: 6897 - DNA, 387 bp, Neisseria gonorrhoeae
atgaggcacgggtatctgccgaaaaatatacagaaattcaaagcgcaacatcgggatttggtgcttcaagattcttcgttgatcaacactggttcgtctccggcagacgatgcggttaaagaagtagagtcgttgctgatgtatggtcagattgaagcggcaatggatgtgttggagcaggcggtattgaaatatcccgacgaatcccagctttatattacgttgatcgatatttatgaacgtactgaagattgggataggttggggcagtttttaagggtattgagggaacgtgcggacaggcttcctgaagaggtcgttatgctgatgagccggctgctgcagcgtatgaatcaaaatattaaaaaaataaaacggtacggaaaa

SEQ ID NO: 6898 - protein, 129 aa, Neisseria gonorrhoeae
MRHGYLPKNIQKFKAQHRDLVLQDSSLINTGSSPADDAVKEVESLLMYGQIEAAMDVLEQAVLKYPDESQLYITLIDIYERTEDWDRLGQFLRVLRERADRLPEEVVMLMSRLLQRMNQNIKKIKRYGK

SEQ ID NO: 6899 - DNA, 591 bp, Neisseria gonorrhoeae
atggcaagcattcaaaacttatacgagaccgtcgtcggcgtgcttggcgatcaggcaggcaaagtcatttcagctttgggcgagattaccgtcgagtgtctgcccgagcactatatttcagtcatgaccgcattgcacgaccatgaagatttgcatttcgagcttctggttgacttgtgcggcgtcgattacagcacttacaaaaacgaagcatggcagggcaaacgctttgccgttgtcagtcagttgctttccgttaaaaacaatcaacgcatccgcgtacgcgtctgggtttcagacgacgacttccctgtagtcgaatccgtagccgatatttacaacagcgcggattggtacgagcgcgaagccttcgatttgtacggcatcatgttcaacaaccatcccgacttgcgccgcatcctgaccgattacggctttgtcggacatccgttccgcaaagacttcccgatttccggctatgtggaaatgcgttatgacgaagagcaaaaacgcgtgatttaccaacctgttaccattgagccgcgcgaaatcacaccgcgtatcgtccgtgaggagaactacggtggccaa

SEQ ID NO: 6900 - protein, 197 aa, Neisseria gonorrhoeae
MASIQNLYETVVGVLGDQAGKVISALGEITVECLPEHYISVMTALHDHEDLHFELLVDLCGVDYSTYKNEAWQGKRFAVVSQLLSVKNNQRIRVRVWVSDDDFPVVESVADIYNSADWYEREAFDLYGIMFNNHPDLRRILTDYGFVGHPFRKDFPISGYVEMRYDEEQKRVIYQPVTIEPREITPRIVREENYGGQ

SEQ ID NO: 6901 - DNA, 171 bp, Neisseria gonorrhoeae
ttgccgacaccatgtcggcaagagcggaattatatttttattgcaagcagacagtcaagcataacgacaagaaaaaagatgattttcttgtttgccgataaatatttaccgacatccctcacaatcagtcggacggctggagaaaatactgtcaatacgttttttccatac

SEQ ID NO: 6902 - protein, 57 aa, Neisseria gonorrhoeae
LPTPCRQERNYIFIASRQSSITTRKKMIFLFADKYLPTSLTISRTAGENTVNTFFPY

SEQ ID NO: 6903 - DNA, 294 bp, Neisseria gonorrhoeae
gtgcggggcaaaaaagacgtgtccggaatcagccaagagaaaatcggtgcgattgccggcctggtccgcgccgatcaaggtgcgaaaatccttaaagacaaagtcagctacgaaacggcatcgaaacaatacgaccgtgccatccaaacttccgaaaaacctgcaaacctgattatcgatgcgttgaaactcgattaccaacacgcggacatagaccgttttgccggacatttgtggaaactttaccaaacgttgggcaactacggcaggcaggttaaagagcggatgctgggt

SEQ ID NO: 6904 - protein, 98 aa, Neisseria gonorrhoeae
VRGKKDVSGISQEKIGAIAGLVRADQGAKILKDKVSYETASKQYDRAIQTSEKPANLIIDALKLDYQHADIDRFAGHLWKLYQTLGNYGRQVKERMLG

SEQ ID NO: 6905 - DNA, 549 bp, Neisseria gonorrhoeae
gtgcctcataccgatgtctttgatttgccgatcgttcggccccttttccaaatcatcgaaaacttcatggtaacccaggctgtacccctaacccagcatccgctctttaacctgcctgccgtagttgcccaacgtttggtaaagtttccacaaatgtccggcaaaacggtctatgtccgcgtgttggtaatcgagtttcaacgcatcgataatcaggtttgcaggtttttcggaagtttggatggcacggtcgtattgtttcgatgccgtttcgtagctgactttgtctttaaggattttcgcaccttgatcggcgcggaccaggccggcaatcgcaccgattttctcttggctgattccggacacgtcttttttgccccgcacaatcgggatgcgcttgatttcttcggctccataagccttaccgccgacatccggcgggggcgatgcggaagctgccgtcgcagaaccgccttccgcacgtttttcaatctcctgagtgccctatcccaaaccttcttccgccaagacgcggatacgcaaatggtt

SEQ ID NO: 6906 - protein, 183 aa, Neisseria gonorrhoeae
VPHTDVFDLPIVRPLFQIIENFMVTQAVPLTQHPLFNLPAVVAQRLVKFPQMSGKTVYVRVLVIEFQRIDNQVCRFFGSLDGTVVLFRCRFVADFVFKDFRTLIGADQAGNRTDFLLADSGHVFFAPHNRDALDFFGSISLTADIRRGRCGSCRRRTAFRTFFNLLSALSQTFFRQDADTQMV

SEQ ID NO: 6907 - DNA, 150 bp, Neisseria gonorrhoeae
tatttttattgcaagcagacagtcaagcataacgacaagaaaaaagatgattttcttgtttgccgataaatatttaccgacatccctcacaatcagtcggacggctggagaaaatactgtcaatacgttttttccatactgacaaaccat

SEQ ID NO: 6908 - protein, 22 aa, Neisseria gonorrhoeae
YFYCKQTVKHNDKKKDDFLVCR

SEQ ID NO: 6909 - DNA, 501 bp, Neisseria gonorrhoeae
atggaaaaaaggtgcgctggaatgggaatagaaggcgttttgaaaaaaggtttcatcaccaccagcgcggatacggtgttgaaccatatgcgtaccggttcattgtggccggttactttcggattggcctgctgcgccgtggaaatgatgcatgcgggtatggcgcgttatgaccttgaccgtttcggtatcattttccgtccgtccccacgtcaggccgacctgatgattgtggcaggtacgctgaccaataaaatggcgccagccctgcgtcgcgtgtacgaccagctcgccgagccgcgctgggtattgtctatgggttcgtgtgccaacggcggcggctattatcactattcttattccgttgtgcgcggtgccgaccgtgtcgtgccggtggacgtttatgtgccgggttgtccgccgactgcggaagctctgatttacggcctgattcagctccaacaaaaaatcaagcgcacttccaccatcgcgcgtgacgag

SEQ ID NO: 6910 - protein, 167 aa, Neisseria gonorrhoeae
MEKRCAGMGIEGVLKKGFITTSADTVLNHMRTGSLWPVTFGLACCAVEMMHAGMARYDLDRFGIIFRPSPRQADLMIVAGTLTNKMAPALRRVYDQLAEPRWVLSMGSCANGGGYYHYSYSVVRGADRVVPVDVYVPGCPPTAEALIYGLIQLQQKIKRTSTIARDE

SEQ ID NO: 6911 - DNA, 411 bp, Neisseria gonorrhoeae
atgattcggactgggtcgatcagacttggtcaatcggtttcagacggcacgcaactcgactggtcttggaacgaaagtgccgagaccgcatccgccgccgtatccgcgcaagaagtcgatccgcttacggagtatcaggtttataagcaattcggttatcagggcaaggctgccgaatctttggctgcctatctggacggcattccggatggtgaagcgaaacctgagaaccttatccgcgagctgatcgatatcaatctcgaagtgggggatgtcgatgttttggcagacaatctgcaaaaatacggcagactgattcctttcgaacttttggcaaaatatatcgaacaggcattacagcgagattcaaaccatttgcgtatccgcgtcttggcggaagaaggtttggga

SEQ ID NO: 6912 - protein, 137 aa, Neisseria gonorrhoeae
MIRTGSIRLGQSVSDGTQLDWSWNESAETASAAVSAQEVDPLTEYQVYKQFGYQGKAAESLAAYLDGIPDGEAKPENLIRELIDINLEVGDVDVLADNLQKYGRLIPFELLAKYIEQALQRDSNHLRIRVLAEEGLG

SEQ ID NO: 6913 - DNA, 378 bp, Neisseria gonorrhoeae
ttgttaacggatttgggtgtaaccatgttgtccgcttattttcccgtctttgtctttatcctcgtcggcctcgcggccggcgtactgtttatcctgctcggcacgattttgggcccgaaacgccactatgccgaaaaagacgcgccttacaaatgcggttttgaatcctttgaaaacgcaaggatgaagttcgacgtgcgctattacctcgtcgacatcctgttcatcctcttcgatttggaggttgcgtttatgctgccgtgggcagtcgtgttcaaagatttgggcgcgtacggcttttggtctatgctggtgtttatcgtcgtcctgacggtaggctttgtttacgaatggaaaaaaggtgcgctggaatgggaa

SEQ ID NO: 6914 - protein, 126 aa, Neisseria gonorrhoeae
LLTDLGVTMLSAYFPVFVFILVGLAAGVLFILLGTILGPKRHYAEKDAPYKCGFESFENARMKFDVRYYLVDILFILFDLEVAFMLPWAVVFKDLGAYGFWSMLVFIVVLTVGFVYEWKKGALEWE

SEQ ID NO: 6915 - DNA, 126 bp, Neisseria gonorrhoeae; identical to SEQ ID NO: 3471

SEQ ID NO: 6916 - protein, 42 aa, Neisseria gonorrhoeae; identical to SEQ ID NO: 3472

SEQ ID NO: 6917 - DNA, 147 bp, Neisseria gonorrhoeae
atacgttttttccatactgacaaaccatcccttgccgctgtgcgaataaaaggcgggcatattgctgttgttcttgttgtaacggaaatttatttggggtgtaaatcctttccacgacagttttttatgccataaagccgcgctcat

SEQ ID NO: 6918 - protein, 44 aa, Neisseria gonorrhoeae
IRFFHTDKPSLAAVRIKGGHIAVVLVVTEIYLGCKSFPRQFFMP

SEQ ID NO: 6919 - DNA, 1329 bp, Neisseria gonorrhoeae; identical to SEQ ID NO: 3767

SEQ ID NO: 6920 - protein, 443 aa, Neisseria gonorrhoeae; identical to SEQ ID NO: 3768

SEQ ID NO: 6921 - DNA, 699 bp, Neisseria gonorrhoeae
atgccgtctgaaaggttcagacggcattttgttgtatgtctgctgtgctgcgtatcagtccagattcaatacggcggaagtgtaaacgtcttgcacgtcgtccaagtcttccagcgcgtcaatcagtttttgcattttgacggcatcgtcgccggagagttcggtttcgttttgggcgcgcatcgtaacgtcgccgtcaacggatttgtaacctgccgcctccaaagcggattttacgcccgcccaatcatttggcgcggtaatgacttcgatggaaccgtcgtcgttggtaaccacgtcttccgcaccggcttccaaagccgcttccatcagctcgtcttcgtcaacgccgggttcgaataccaaatagccctgatgcacgaagttgaacgccacgcagccgtcggtacccaagttgccgccgtttttggtaaatgcgtggcgtacgtccgcaacggtgcgggttttgttgtcggtcaggcagtccaccatcaaagctgcgccgccgatgccgtagccttcgtagcgcaactcgatgtattccacgccttccaagttacccgtacctttgtcgatggcgcgttgcacattgtctttgggcatattgttttcggctgctttttccaaagccagacgcaggcgcggatttgcgccgggatcgccgccgcccatacgcgccgcaacggtgatttctttgat

SEQ ID NO: 6922 - protein, 233 aa, Neisseria gonorrhoeae
MPSERFRRHFVVCLLCCVSVQIQYGGSVNVLHVVQVFQRVNQFLHFDGIVAGEFGFVLGAHRNVAVNGFVTCRLQSGFYARPIIWRGNDFDGTVVVGNHVFRTGFQSRFHQLVFVNAGFEYQIALMHEVERHAAVGTQVAAVFGKCVAYVRNGAGFVVGQAVHHQSCAADAVAFVAQLDVFHAFQVTRTFVDGALHIVFGHIVFGCFFQSQTQARICAGIAAAHTRRNGDFFD

SEQ ID NO: 6923 - DNA, 210 bp, Neisseria gonorrhoeae
ttgcttccgggcggctgcccctgcgtattgccgacaccttgggatttgcgcttcggtgttttcttaccctgcttcgcacgcataaccaaaagcatcagcaataccgccagtgccagaccgataattaatgagttttccaaaggaaacccccgataccgtaacgagcggatagctgaccgcccgcaacggccaattgtccgcttttattat

SEQ ID NO: 6924 - protein, 70 aa, Neisseria gonorrhoeae
LLPGGCPCVLPTPWDLRFGVFLPCFARITKSISNTASARPIINEFSKGNPRYRNERIADRPQRPIVRFYY

SEQ ID NO: 6925 - DNA, 927 bp, Neisseria gonorrhoeae; identical to SEQ ID NO: 159

SEQ ID NO: 6926 - protein, 9 aa, Neisseria gonorrhoeae
IITPSKIVN

SEQ ID NO: 6927 - DNA, 1524 bp, Neisseria gonorrhoeae
ttgctgcttcagtatggctgcgttacagaaaggatggatatggtgaacactaaaccgaatactagtttgatttatatgctttctttccttagcggattattgagcttgggtatagaagtcttgtgggtaaggatgttttcgttcgcagcacagtccgtgcctcaggcattttcatttactcttgcctgttttctgaccggtatcgccgtcggcgcgtattttggcaaacggatttgccgcagccgctttgttgatattccctttatcgggcagtgcttcttgtgggcgggtattgccgattttttgattttgggtgctgcgtggttgttgacgggtttttccggcttcgtccaccacgccggtatcttcattaccctgtctgccgtcgtcagggggttgattttcccacttgtacaccatgtgggtacggatggcaacaaatccggacgacaggtttccaatgtttatttcgccaacgttgccggcagtgcattgggtccggtccttatcggctttgtgatacttgatttcttgtccacccaacagatttacctgctcatctgtttgatttctgctgctgtccctttgttttgtacactgttccaaaaaagtctccgactgaatgcagtgtcggtagcagtttccctaatgttcggcatcctcatgttcctactgccggattctgtctttcaaaatattgctggccgtccggataggttgattgaaaacaaacacggcattgttgcggtttaccatagagatggtgataaggttgtttatggggcgaatgtatacgacggcgcatacaataccgatatattcaatagtgtcaacggcatcgaacgtgcctatctgctaccctccctgaagtccggcatacgccgcattttcgtcgttggattgagtacaggttcgtgggcgcgcgtcttgtctgccattccggaaatgcagtcgatgatcgttgcggaaatcaatccggcataccgtagccttatcgcggacgagccgcaaatcgcaccgcttttgcaggacaaacgtgttgaaattgtattggatgacggtaggaaatggctgcgtcgccatcctgatgaaaaattcgacctgattttgatgaattcgacttggtactggcgtgcctattccactaacctgttgagtgcggaatttttaaaacaggtgcaaagccaccttaccccggatggtattgtaatgtttaataccacgcacagcccgcatgcttttgctaccgccgtacacagtattccctatgcataccgctacgggcatatggtagtcggctcggcaaccccggtagttttccctaataaagaactgctcaagcaacgcctttcccggttgatttggccggaaagcggcaggcacgtatttgacagcagcaccgtggatgctgcagcacaaaaggttgtctctcgtatgctgattcggatgacggaaccttcggctggggcggaagtcattactgacgataatatgattgtagaatacaaatacggcagagggatt

SEQ ID NO: 6928 - protein, 508 aa, Neisseria gonorrhoeae
LLLQYGCVTERMDMVNTKPNTSLIYMLSFLSGLLSLGIEVLWVRMFSFAAQSVPQAFSFTLACFLTGIAVGAYFGKRICRSRFVDIPFIGQCFLWAGIADFLILGAAWLLTGFSGFVHHAGIFITLSAVVRGLIFPLVHHVGTDGNKSGRQVSNVYFANVAGSALGPVLIGFVILDFLSTQQIYLLICLISAAVPLFCTLFQKSLRLNAVSVAVSLMFGILMFLLPDSVFQNIAGRPDRLIENKHGIVAVYHRDGDKVVYGANVYDGAYNTDIFNSVNGIERAYLLPSLKSGIRRIFVVGLSTGSWARVLSAIPEMQSMIVAEINPAYRSLIADEPQIAPLLQDKRVEIVLDDGRKWLRRHPDEKFDLILMNSTWYWRAYSTNLLSAEFLKQVQSHLTPDGIVMFNTTHSPHAFATAVHSIPYAYRYGHMVVGSATPVVFPNKELLKQRLSRLIWPESGRHVFDSSTVDAAAQKVVSRMLIRMTEPSAGAEVITDDNMIVEYKYGRGI

SEQ ID NO: 6929 - DNA, 282 bp, Neisseria gonorrhoeae
cggtatagatcggccgcctcgaacatcgccgcctgccgcgcttttaggaacttcagacggcattgcatcgcgaaccggcggcacatcctctgcaaacggcaggagggcgaggctttccccttcagacggcatcgcagcccgactaccgacgttaatcggttcgacaggcacgccgatatcctcggcaaacgtcgccgaagcgattaggtatcccataaaaaagatatttttagatttcatcaatttcataacaaattcaaataaaatgcccagcaacgccat

SEQ ID NO: 6930 - protein, 68 aa, Neisseria gonorrhoeae
RYRSAASNIAACRAFRNFRRHCIANRRHILCKRQEGEAFPFRRHRSPTTDVNRFDRHADILGKRRRSD

SEQ ID NO: 6931 - DNA, 633 bp, Neisseria gonorrhoeae
ttgaaaatagaaaatatgaattcgaccgcaagtaaaaccctgaaaggattgtcgctggtgtttttcgcctctggcttctgcgccctgatttaccaggtcagctggcagaggcttctattcagccacataggtatcgatttgagttcgattactgtcattatttctgtatttatggtcggcttgggtgtaggtgcgtatttcggcggacgcattgctgaccgttttccttcaagtatcatccccctgttttgcatcgctgaagtatccatcggtctgttcggtttggtaagcaagggtctgatttccggcttggggcatcttttagttgaggctgatttgcccatcatcgctgctgccaatttcctcttattgctgcttcctacctttatgatgggcgcgaccttgcccttgctgacctgtttttttaaccggaaaatacataatgttggcgagtctatcggtaccttatattttttcaacactttgggtgcggcactcggatcgcttgccgccgccgaatttttctacgtcttttttaccctctcccaaaccattgcgctgacagcctgccttaaccttctgattgctgcttcagtatggctgcgttacagaaaggatggatatggtgaacac

SEQ ID NO: 6932 - protein, 211 aa, Neisseria gonorrhoeae
LKIENMNSTASKTLKGLSLVFFASGFCALIYQVSWQRLLFSHIGIDLSSITVIISVFMVGLGVGAYFGGRIADRFPSSIIPLFCIAEVSIGLFGLVSKGLISGLGHLLVEADLPIIAAANFLLLLLPTFMMGATLPLLTCFFNRKIHNVGESIGTLYFFNTLGAALGSLAAAEFFYVFFTLSQTIALTACLNLLIAASVWLRYRKDGYGEH

SEQ ID NO: 6933 - DNA, 240 bp, Neisseria gonorrhoeae
atgcccagcaacgccatttttcttttcgtattgcccggccatttatgttcagtaagaatcaactgttttaaaagaaattattgctgttttgaggtattgcattgccgcttggcagtattcgatttggcggactgttttttgaagaaaatgccgtctgaaacttcagacggcatcttgcccggacaaacggcactaaatagaaatagtgctttctctatttcttctcgccgccgaaaccga

SEQ ID NO: 6934 - protein, 80 aa, Neisseria gonorrhoeae
MPSNAIFLFVLPGHLCSVRINCFKRNYCCFEVLHCRLAVFDLADCFLKKMPSETSDGILPGQTALNRNSAFSISSRRRNR

SEQ ID NO: 6935 - DNA, 150 bp, Neisseria gonorrhoeae
gtgccttgctgcaaaaacagatttcagcgaattattggttatttaatgatttgtgcgatgtacgaagccgactggctgaaaaactgcctcaatcctttgatttttattgcggcgatgcggaaaattttccttttcaacgacaatttgact

SEQ ID NO: 6936 - protein, 50 aa, Neisseria gonorrhoeae
VPCCKNRFQRIIGYLMICAMYEADWLKNCLNPLIFIAAMRKIFLFNDNLT

SEQ ID NO: 6937 - DNA, 120 bp, Neisseria gonorrhoeae
atgaagccgcacagcagtttgaacagtgatacgccgtttgcgggcttacgagtttattttcccggcctgcagtttgagcaatgcggtgatttcctacggctaatacaaatgtttacacat

SEQ ID NO: 6938 - protein, 40 aa, Neisseria gonorrhoeae
MKPHSSLNSDTPFAGLRVYFPGLQFEQCGDFLRLIQMFTH

SEQ ID NO: 6939 - DNA, 792 bp, Neisseria gonorrhoeae
ttggtcggcactatggaatcactgactgccataaataaaccgcgcattcggcaggctttccaaaaagcattaagcgattatgacaggcacgccttaatccaacaaaaaatgacgattaatctaatcgcgcatttgcaagattatttgccggatatgccattggaaaacgtgttggaattgggctgcggctcaggaatgttgagtgccttgctgcaaaaacagatttcagcgaattattggttatttaatgatttgtgcgatgtacgaagccgactggctgaaaaactgcctcaatcctttgatttttattgcggcgatgcggaaaattttccttttcaacgacaatttgacttaatcgcaagcgcatctgccgtgcaatggtttcaccaacccgacgcttttatcgcccattgcaaaacaggcttgaaaacaaacggattattggcggttgcgacctttggcaaagacaatttaaaagaagtccgccaaatcacaaatataggcttaaattacccgactttatcccaatggcaggcttggttagccaaagattttgagcttttatggtgtgaggattttaaggtaatactagactttgatacgccgttagatgtactcaaacaccttaaatatacaggcgttaccgccacgaaccaaaaaaattggacaagaaaaaatctcaatggatttattggcgattacttgtcggcgttcggtatgccgtcgggcaaagtgcgcctgacttatcatccgttattttttatcgcgcgccactctgcggcgggcaggcaa

SEQ ID NO: 6940 - protein, 264 aa, Neisseria gonorrhoeae
LVGTMESLTAINKPRIRQAFQKALSDYDRHALIQQKMTINLIAHLQDYLPDMPLENVLELGCGSGMLSALLQKQISANYWLFNDLCDVRSRLAEKLPQSFDFYCGDAENFPFQRQFDLIASASAVQWFHQPDAFIAHCKTGLKTNGLLAVATFGKDNLKEVRQITNIGLNYPTLSQWQAWLAKDFELLWCEDFKVILDFDTPLDVLKHLKYTGVTATNQKNWTRKNLNGFIGDYLSAFGMPSGKVRLTYHPLFFIARHSAAGRQ

SEQ ID NO: 6941 - DNA, 345 bp, Neisseria gonorrhoeae
atgagaaaaagccgtctaagccggtataaacaaaataaactcattgaactgtttgtcgcaggcgtaactgcaagaacagcaacagagcctgacagcattgtttatacggattgttatcgtcgctatgatgtattggatgcaggcgaatttagccatttccgtatcaatcacagcacacattttgccgaacgacaaaaccatattaatggaattgggaacttttggaaccgggcaaaacgtcatttacgcaagtttgacggcattcccaaagagcattttgagccgtatttaaaggagtgcgaacggcgttttaacaacagtgagataaaagttcttgttccattt

SEQ ID NO: 6942 - protein, 115 aa, Neisseria gonorrhoeae; identical to SEQ ID NO: 6216

SEQ ID NO: 6943 - DNA, 1059 bp, Neisseria gonorrhoeae
tttcttctcgccgccgaaaccgataacagcttgatgtttatgctcttggcttacagcacctgctacttcattagccgcttcgccgaaaatacccaaatgatactttttaatctcattatccttctctaacatagccaccccttcgttcacgccgaaataagaaacccggtctttcaaccccaagctggagccggactctcgataagggattctctcaatagcagcttcttctaatttgatcttgccatattgttccattccttcaattgagccagagccttttctacgatcaaaatcaattgtgtatctaaatacgccattatggttatctaacgattctttggataaaaccccattaccgccaaatgcccgaccttcatattgaaagctcccagccttgggtaatttgtcttcatctgttgccacgcctctaatgtcgcccagatacaagtcaaaaggaatctcttcaggattttgtccatccccttctataggattaccgtcttttcgactgtagccaaaatagcctctaaccacagaatacggttgctcataaacccaagtttttaatagcgcataattctgttctttatccgcaccgtaaaactcaatcttttgctcactcaaacctttggggagaacatctagttccccccccttactaccttcgtattttttaccattaacatatacatccatcttctgaagttgttccttactaaacggctcttcgccgtctagaaatagcattgccttgacagattcacccttaccgagcttacctgcatattgttttcgcactcctgtatattcatcacctttaacctttaatactttggcttgcaattcttttggtacatcttttaatgatgatttcttcagatattcaataactttttcatctttcgcatcaacatttgcattgtctttcagttgttccgaaacgcttggttgaaccgacatagatgaatcggaaccgccacccgcgcacgctgttagccccatagaagcaataacagcaataacaagtttattcattgctgattgagatactttcat

SEQ ID NO: 6944 - protein, 42 aa, Neisseria gonorrhoeae
FLLAAETDNSLMFMLLAYSTCYFISRFAENTQMILFNLIILL

SEQ ID NO: 6945 - DNA, 93 bp, Neisseria gonorrhoeae
gtggtcaatgggcgtttgggcggcagagagggcattgcaaggaataagattaaaatccgcaacggcagtgaatggcacaggtttgccttgcga

SEQ ID NO: 6946 - protein, 31 aa, Neisseria gonorrhoeae
VVNGRLGGREGIARNKIKIRNGSEWHRFALR

SEQ ID NO: 6947 - DNA, 198 bp, Neisseria gonorrhoeae
atgcccggatgcgtgattattttgccgcaaacgataccgccgaaaacggtattcggacggcttgatttgagttttggtatttttgcccgacggggtggaaaatacagttgctacggctcgatgaatcgtcagaaatacccgaaccgtcattcccgctcaggcgggaatctaggtctgtcggtgcggaaatttatcggg

SEQ ID NO: 6948 - protein, 66 aa, Neisseria gonorrhoeae
MPGCVIILPQTIPPKTVFGRLDLSFGIFARRGGKYSCYGSMNRQKYPNRHSRSGGNLGLSVRKFIG

SEQ ID NO: 6949 - DNA, 135 bp, Neisseria gonorrhoeae
atgcataatttgacggcacgaagatatgggacacttatcgggcttatatccacacgcctcaaaatgacgaaaacgcttgtttttgccttaatcggacaaagaaaaaccgcaagctcaaggcttgcggttttttat

SEQ ID NO: 6950 - protein, 45 aa, Neisseria gonorrhoeae
MHNLTARRYGTLIGLISTRLKMTKTLVFALIGQRKTASSRLAVFY

SEQ ID NO: 6951 - DNA, 183 bp, Neisseria gonorrhoeae; identical to SEQ ID NO: 3585

SEQ ID NO: 6952 - protein, 61 aa, Neisseria gonorrhoeae; identical to SEQ ID NO: 3586

SEQ ID NO: 6953 - DNA, 645 bp, Neisseria gonorrhoeae
atgaaaacaaaattttacaatcatcaaggcgaacatttaatcctgtattttgcaggttggggaatgccgcccgatgctgtaaatcatttgattttgccggaaaatcacgatttattgatttgctatgattatcaagatttaaatttggattttgatttttccgcctatcggcacatccgtttggtggcgtggtcaatgggcgtttgggcggcagagagggcattgcaaggaataagattaaaatccgcaacggcagtgaatggcacaggtttgccttgcgatgataatttcggtatcccttgcgccgtttttaaaggcacattggagaatctcacagaaaatactcgttcaaagtttgaacgtagaatctgtggcgataaagcatcttttgaagattaccaacaatttcccgcccgtccgtttgacgaaattcatcaagaacttaccgcactttttgcgatgatcgggcaagataggcgtacagatcttatccgctggacaaacgccttgttcggatcgggcgataaaatttttattcctgccaatcagcaccgatattggacaccgcgttgcaccgttcaagaaacagacggcgggcattacctgttttcaagatttacccattggtcggcactatggaatcac

SEQ ID NO: 6954 - protein, 215 aa, Neisseria gonorrhoeae
MKTKFYNHQGEHLILYFAGWGMPPDAVNHLILPENHDLLICYDYQDLNLDFDFSAYRHIRLVAWSMGVWAAERALQGIRLKSATAVNGTGLPCDDNFGIPCAVFKGTLENLTENTRSKFERRICGDKASFEDYQQFPARPFDEIHQELTALFAMIGQDRRTDLIRWTNALFGSGDKIFIPANQHRYWTPRCTVQETDGGHYLFSRFTHWSALWNH

SEQ ID NO: 6955 - DNA, 225 bp, Neisseria gonorrhoeae; identical to SEQ ID NO: 3603

SEQ ID NO: 6956 - protein, 75 aa, Neisseria gonorrhoeae; identical to SEQ ID NO: 3604

SEQ ID NO: 6957 - DNA, 4173 bp, Neisseria gonorrhoeae
ttcatccgttacttgggtttcagcagtctcctgctctaccccttgccattgctgatgacggctgcggtgataagtcaaaccggtaccggcaggaatcaggcgaccgacgatgacattctctttcagaccgcgcagttcgtcttgtttgcccatgatggcagcttcggtcaacacacgggtggtttcttggaacgatgcggcagaaatgaagctgtcggtggacagggaggctttggtaatacccagcaatatgttttcgtaacgtgccggctctttgccttcttccaaagctttttcattggccgccatcacatcgccgcgttcgacctgctctccggtaataaacccggtttcgccggcatccgcaatgttcacacggcgcaacatttgacggatgatgacttcgatgtgtttatcggaaatcttcacaccttgcaggcggtaaacctcttgcacctcttggacaatgtagcgtgccagtgcttcgataccttgcagacgcagaatatcgtgcggatcgaccgcgccgtccacaatggtttcgcctcggtttaccacttgaccgtcatgtaccagaatttgtttctctttggaaatcaaagtctcgtatgctacaccgtccacgtcagtgataatcagacgttgtttgcctttggtctccttaccgaaggaaacggtaccggtaatttccgccagcataccggcatctttcggcacgcgtgcttcaaacagctcggcaacgcgcggcagaccgccggtaatgtcgcgggttttggaagaggcttgcggaatacgcgccaatacgtcgcctttaccgatttcctgaccttcgcgtacggtaatcaccgcaccaacggggaatgccatcgaaaccggagtggacgtaccgggaatacagatttccacgccgttttcgtccaagagtttcacagtcggacgcagcagtttggaagcactagaggaacggcgtttaccgtcaatcactaccaaagtggacaaaccggttacatcatcggtttgttttgcaacggtaacgccctcttccatgttctcgaatttcaccatacctgcatgttcggtaatcatcggacgggtatgcggatcccaagttgccaaggtttgaccggctttaatggccataccgtcttgtaccagcaggatggcaccgtaaggtactttgtggcgttcgcgttcacggccgatgtcatcgtgaatcacgacttcgcaagaacggccgatgacaaccaactcgcctttgttgttggcaacataacgcatttggctgctgaaacgtgccgtaccgttggatttggcttcgacttggctggctgctgccgcacgggatgccgcaccaccgatgtggaacgtacgcatggtcaactgggtacccggttcaccaatagactgagccgcaatcacgccgactgcctcgccggcattgaccagtttgccgcgcgccaagtcgcggccgtaacagtgcgcgcacagaccgtggcgggttttacaagtaatcggagtacggactttgacttcatcgacaccggattggtcaatcatatccaccagtttttcagtcaacaacgtaccggcttcaaccaaagtctcgccgcttgacggatcgacaacgtcagacgcggtaacacgacccaaaatacgatcgcgcaatgcttcaatcacatcaccgccttgtaccactgccttcatgacaaagccgtctgaagtaccgcaatcgtcttcaacaacgaccaagtcttgagttacatccaccagacgacgggtcaggtaaccggagttcgcggttttcaacgcggtatccgccaaacccttacgcgcaccgtgggtcgcaataaagtattgcaatacggtcagaccttcgcggaagtttgaggtaatcggcgtttcaataatcgatccgtcaggtttcgccatcaaaccgcgcataccggacaactgtttaatctgagccgcagaaccacgggcaccggagtccgccatcatataaatggagttgaatgactcttgatcgacttcgttgccgtcacggtcgataactttttgtttggacaggttgtccatcatcgctttagcaatcttatcgccggcacgaccccaaatatcgaccactttgttgtagcgttcgccgttggtaaccaaaccttgacggtattggtcttcgatttctttaacttcggcattggcttcagccagcaaggccgctttttcttttggaatttccatatcgtcaacggcaatggaaataccgccttttgccgcaaatccgaaaccggtgtacatcaggtggtcggcgaagataaccgtatcgcgcaagccgcacaggcggaacgatgcgttaatcagcttggaaatttcttttttcttcaacgctttgttgacatattcaaacggcaggcctttcggcaggatttcgctcaacaatgcacggccgacggttgtttcgtaacggttaacgacaggctcaaactcacctgcttcgtttttcacccattcgcgcagacgtacggtgatttttgtacccagctcgacctgtttggtatggtatgcacgatgcacttctttcacatcggcaaacaggctgccctcgcctttggcattgatacggtcgcgggtcatgtagtacagacccaatacgatgtcttgggaaggtacgataatcggttcgccgttggcaggagacaatacgttgtttgaagccagcatcagcgtgcgtgcttccatttgcgcttccaagctcaatggaacgtgtactgccatttggtcaccgtcaaagtcggcattaaatgcggcacacaccaatgggtgcaactgaatcgctttaccttcgatcagaataggctcgaacgcttgaatacccaaacggtgcagggtcggcgcacggttcaacataatcggatgttcgcggatgacttcttccaagatatcccatacttcaggtacttcttgttctaccaattttttcgcagctttaacggtagacgccaaaccttgtttttccaatttgtggaaaataaatggtttgaacagttccaacgccatttttttcggcaaaccgcattggtgcagacgcaggtatgggcctacggtaatcacggaacggccggagtagtccacacgtttgcccaacaggttttgacggaagcggccgcctttacctttaatcatatctgccaacgatttcagcggacgtttgttggctccggtcatggctttaccgcgacggccgttatccaacagcgaatcaaccgcttcttgcaacatacgtttttcgttgcggacgatgatgtcaggcgcatgcagttccagcaggcgtttcagacggttgttgcggttgatgacgcggcggtacaaatcgttcaaatcggaagtggcaaaacggccgccgtccaacggaaccaacggacgcaaatcaggcggcaataccggcagcacatccataatcatccactccagcttcataccggaacgatggaaggcttccaatactttcaagcgtttagcgatttttttgattttggtgtcagaaccggtcgattcaagctcttggcgcaggatttcgatttcgcctgctacatccaaggttcgcaacaattcgcggataccttccgcacccattttggcatcgaagtcgtcgccgtattcgtccagtttgttgtagtaatcgtcttcagtcagcaattgacgacgttgcaacggagtcatgccgggatcggtcaccacgaatgcttcaaagtacaatacgcgttcgatatcacgcaacgtcatgttcaataccatacccaagcgggaaggcagggatttcaagaaccaaatatgggcaacgggtgcagccaattcgatatggcccatgcgttcgcggcgcactttggacagggtaacttctacgccacatttttcacaggttacgcctttaaatttcaatcgtttgtattttccgcacaagcattcgtagtctttgaccgggccaaagattttggcgcagaacaagccgtcgcgctcgggtttgaacgtacggtagttgatggtttcaggttttttaacttcgccataagaccatgagcggatggtttcgggagaggcaataccgattttgatggcatcaaactcttcttccatacctgcggtttgcaacggattaaataagttcaacaaattcat

SEQ ID NO: 6958 - protein, 537 aa, Neisseria gonorrhoeae
FIRYLGFSSLLLYPLPLLMTAAVISQTGTGRNQATDDDILFQTAQFVLFAHDGSFGQHTGGFLERCGRNEAVGGQGGFGNTQQYVFVTCRLFAFFQSFFIGRHHIAAFDLLSGNKPGFAGIRNVHTAQHLTDDDFDVFIGNLHTLQAVNLLHLLDNVACQCFDTLQTQNIVRIDRAVHNGFASVYHLTVMYQNLFLFGNQSLVCYTVHVSDNQTLFAFGLLTEGNGTGNFRQHTGIFRHACFKQLGNARQTAGNVAGFGRGLRNTRQYVAFTDFLTFAYGNHRTNGECHRNRSGRTGNTDFHAVFVQEFHSRTQQFGSTRGTAFTVNHYQSGQTGYIIGLFCNGNALFHVLEFHHTCMFGNHRTGMRIPSCQGLTGFNGHTVLYQQDGTVRYFVAFAFTADVIVNHDFARTADDNQLAFVVGNITHLAAETCRTVGFGFDLAGCCRTGCRTTDVERTHGQLGTRFTNRLSRNHADCLAGIDQFAARQVAAVTVRAQTVAGFTSNRSTDFDFIDTGLVNHIHQFFSQQRTGFNQSLAA

SEQ ID NO: 6959 - DNA, 126 bp, Neisseria gonorrhoeae
atggctgccgcggcagcgacacgttttgaaccgcttattcgggatttccaccaacgcctgctgtatagcggattaacaaaaaccggtacggcgttgccccgccccggctcaaagggaacggttccc

SEQ ID NO: 6960 - protein, 42 aa, Neisseria gonorrhoeae
MAAAAATRFEPLIRDFHQRLLYSGLTKTGTALPRPGSKGTVP

SEQ ID NO: 6961 - DNA, 105 bp, Neisseria gonorrhoeae
ttgcccgttaataaacgtgatgaagaactggtaaaagagggaaaattaccgccgtattgctgcaaaaaagaccggcgtaagttttcatctgatgccaaccccaaa

SEQ ID NO: 6962 - protein, 35 aa, Neisseria gonorrhoeae
LPVNKRDEELVKEGKLPPYCCKKDRRKFSSDANPK

SEQ ID NO: 6963 - DNA, 243 bp, Neisseria gonorrhoeae
ttggcaactgtccggttgtgccgatgggttgccctgccgctccctgagctacgcaacggttgtctgccttgggcgggcgcgggtggcggccgggcggtttgtcgctatgatacggaagttccgatatacaagggcgggcttcagcccgccaaatccaccaactccgccgaatccgccgattcccgccgccgtcattcccgcataagcgggaatccagacctgtcggtgcggaaacttatcgga

SEQ ID NO: 6964 - protein, 81 aa, Neisseria gonorrhoeae
LATVRLCRWVALPLPELRNGCLPWAGAGGGRAVCRYDTEVPIYKGGLQPAKSTNSAESADSRRRHSRISGNPDLSVRKLIG

SEQ ID NO: 6965 - DNA, 4182 bp, Neisseria gonorrhoeae
gtagcgttccaaatcgatatccaaacccagtgagcgaatctctttgaccaatacgttgaaggactcgggcataccggcatcgattttgtgttcgcctttgacgatgttttcgtacattttggtacggccgttcacgtcgtcagacttcacagtcagcatctcttgcagcgtgtatgccgcgccgtatgcttccaatgcccaaacctccatctcaccgaaacgttggccgccaaactgagctttaccgcccagaggttgttgagtaaccagactgtacgggccggtagaacgcgcgtgcattttttcgtcaaccaagtggtgcagtttcagatagtgcatcacaccgactgtaaccttgcggtcaaatgcttcgcctgaacggccgtcatacagcgtgatttgagttttactgtcgttgaagcccagtttctcaacctcaggatcttcgcttgggtaagccaagttcaacatttcgcggatttcagactctttcgcaccgtcgaatacaggagaggcgaaagatgcacctttacgcagattggaagccaattcgatgatttcttcatcagtcaggctgtccaaatcttctttcttaccgctgccgttgtagagtttgttcaagaactcgcgcagctcgccggctttgcgtcgctctttcagcatacggtcgatgcgctcgccgataccttttgccgcccaacccaagtgaacttccaaaatctgaccgatgttcatacgggaaggtacgcccaacgggttcagtacgatgtccacaggacggccgtccgccatgtacggcatgtcttccacaggcagaatgcgagataccacacctttattaccgtggcggcccgccattttgtcaccggcttgcagacggcgtttgatggcgataaagactttcaccattttttgtacgccgggttgcagctcgtcgccttgggtcagttttttcttcttgatctcatacaactcatccgcttcttcgcgtttttgttgcaggctcaatttaatcagttccaactgcttggccaaatcttcatcggtcaaacggatatcgaaccaatcgtgcctgctcggcagacccgccagatattcggtcgtgatttcgctgcctttggtcagcttcatcgggccgccgttggctttctgaccgacaatcatacgctcgatacggtcgaatgcgtcgttgtcgaaaatacgcaattggtcgttcaaatccaaacggtagcgtttcaactcggaatcgataatggattgggcgcgtttgtcgcgttggatgccttcgcgggtaaagacttgaacgtcgataaccgtaccgctcataccggtaggcatacgcaatgaagtatcttttacgtcagacgctttttcgccgaagatggcgcgcagcagtttttcttccggcgtcagctgggtttcgcctttaggcgttaccttgcctaccaacacatcgccggcttctacttccgcaccgatgtaaacgataccggattcgtccaaacggttttgcatacgctcggacaagttcggaatatcgcgggtaatgtcttccgcacccagcttggtatcgcgggcaacgacattcaattcctcaatgtgaatcgaagtatagcggtcgtccgcagccactttttcggaaatcagaatcgagtcttcgtagttgtaaccgttccacggcatgaaggcgatggtcatattttgacccaaagccaattcgcccaaatcggtggacgcgccgtcggccaccaaatcgccgcgttgcaaaacatcgcctgctttgacagccggacgttggttgatgttggtagattgattggaacgggtgaatttaaccaaattgtaaatatcgacacccacttcaccggcagtcgcttcgtcgtcatggacacggatcacaacgcggttggcatcgacatactcgaccacgccgcctcggcgggcaacgattgcagtagcagagtcaacggcaacggaacgctcgataccggtaccgaccatcggtttttcaggacgcagacaaggcactgcctgacgttgcatgttggcacccatcaatgcgcggttcgcgtcatcgtgttccaagaacggaatcagggatgccgcaacggataccacctgaccggttgccacgtccatatattggacgcggtcgggcgttgccataatggtttcgcctttttcacgacaggtaaccaaatcgccaatcagattgccgtctgaatccaaatcggcattcgcctgtgcaatcacatagcggccttcttcgatggcagacaagtaatcaatttcctcggttactttgccgtcaataacgcggcggtaaggcgtttccaagaaaccgtaatcattggtgcgcgcgtaaacagacaatgagttgatcaaaccgatgttcggaccttcaggcgtttcaataggacatacacgtccatagtgggtcggatgcacgtcccgcacttcgaagccggcacgttcgcgggtcaaaccgcccggacccaatgcagatacacggcgtttatgggttacttcagacaagggattggtctgatccataaactgactcaattggctggagccgaagaattctttgatggcggcagaaacgggtttcgcattaatcaagtcgtgcggcatcaagttttctgattccgcctgattcaaacgttcttttacggcacgttccacacgagccaaaccgctgcggaattggttttcagtcagctcgcctaccgaccgtactcgacggttgcccaagtgatcgatatcgtccacttcgccatggccgttacgcaactcgaccaaagtcgcaatcgaggcgacaatatcttcgacgctcaggacataaccgcctttgtcggcagcaccggcaaacgtctcgttcaacaggcggccgtaccaagagttttgttgggcttcggacagtttttgttcgtatgtgcgcgtattaaatttcatacggcctacgcgggacaaatcgtagctgtcttcactgaagaacaagcggttaaacaattgctcgaccgcctcttcggtgggcggttcgcccggacgcatcatacggtaaatcgcaacacgcgccgcctgccggccggcagtctcatccgtgcgcaaggtattggaaatataagcaccctgatccaactcattgatgtaaagggtcgtaatttcttttacgccgttaatatcaaatttggccaacaactcttctgtaatttcatcattggcagaagccaatacctcgccggtttccgaatcaatcaaatcggcagccaatgctttgcccagcaggctttcctgttctacatccaaacgggtcaggcctgcattggtaatatcacggatatttttcgcagtaatgcgcttacctttggcaaccaatacattgccttctttatccaagatatcgaccttggcagtttcgcctttcagacggcctgcgaccaaatcggtttgaacaccgtttgaagacaaataaaacgtttctttgtcgtagaaaatatccaagatttgctcattgttgtagcccaaagccttcaacaaaatcgttaccggcattttacggcggcggtcgatacggaaatacagcaaatctttcggatcaaattcaaaatccaaccatgaaccacggtagggaatgatgcgggcggagaataacaatttgccggaagagtgtgtcttacctttgtcatgctcgaagaacacaccgggcgaacggtgcaactgggaaacaatcacacgctctgtgccgttaatcacaaaagaaccgctcggggtcatcaacggaatttcgcccatatacacttcgttttcacgaacttcttttaccgtcggtttagacgcttccttatccaaaatcaccaaacggatacgcgcgcgcagaggggcagcataagtgattccgcgcaattgacattcagggatatcgaacaaaggctcgcccagcgtgtaatatacaaactccagacgagcataaccgttgtggctcacaatcgggaaaatagaattaaatgccgcttgcagaccgtcatcggtacgtttgtcaaaagcattttccagctgcaaaaatttcgcataagaatcaatttgggttgccagtagaaaaggaacttccaaaacattttcccgctttgcaaaactcttacggatacgttttttctcggtaaacgaatagttcatacacac

SEQ ID NO: 6966 - protein, 10 aa, Neisseria gonorrhoeae
VAFQIDIQTQ

SEQ ID NO: 6967 - DNA, 120 bp, Neisseria gonorrhoeae
tacacactccgaaaagtaattttcaataataggccgtctgaaaacaacggtacgcatcaatctgatatttacatttatttgcaatgatttgataaaaactatgcaaataaatgtaaacaa

SEQ ID NO: 6968 - protein, 28 aa, Neisseria gonorrhoeae
YTLRKVIFNNRPSENNGTHQSDIYIYLQ

SEQ ID NO: 6969 - DNA, 1074 bp, Neisseria gonorrhoeae
ttgattcatcaagggcggtatattacacgggaaaaccgcaaaatgctgaatatgtcgtctaatgattatttggggttggcatcagatgaaaacttacgccggtcttttttgcagcaatacggcggtaattttccctcttttaccagttcttcatcacgtttattaacgggcaactttcctatttataccgatttggaagagcttgtcgcacaacgtttccaacgggaaagcgcgttattgttcaacagcggctatcacgccaatctcggtattttgcctgctttgacgacgacgaaaagtttgattttggcagataaattcgttcacgccagtatgattgacggcatccgtttgagccggtgtgcgtttttccgttatcgtcataatgattatgaacatttgaaaaatctgcttgaaaaaaacgtcggaaaatttgaccgcacttttatcgttaccgaatctgttttcagtatggacggcgatgtggcggatttgaaacagcttgtccaattaaaaaaacagtttcccaatacttatctttatgtggatgaagcccacgcaatcggtgtttatgggcaaaacggattggggattgccgaacgggataatctgattgccgagattgatttattggtcggcactttcggtaaagccttagcctcggtgggggcgtatgccgtctgcaaccaagtattgaaagaatgtttgattaatcaaatgcgcccattgattttttcaaccgcattgccgccgtttaatgtggcttggacttattttatttttgaacgattgccgcaattctcaaaagaaagaagtcatcttgagcagttaagcgcatttttacggcgggaagtggcgcatcggacgcaaataatgccgagcgaaacctgtatcgtcccctatattttaggcgggaatgaagccacccttgccaaagcggaatatctgcaaggtcagggttattattgcctgcccatcggaccgccgacagtaccaaaaaacacatccagaatccgcctgtctttaactgccgatatgacaacggatgaagttcggcagtttgcggcgtgcctg

SEQ ID NO: 6970 - protein, 358 aa, Neisseria gonorrhoeae
LIHQGRYITRENRKMLNMSSNDYLGLASDENLRRSFLQQYGGNFPSFTSSSSRLLTGNFPIYTDLEELVAQRFQRESALLFNSGYHANLGILPALTTTKSLILADKFVHASMIDGIRLSRCAFFRYRHNDYEHLKNLLEKNVGKFDRTFIVTESVFSMDGDVADLKQLVQLKKQFPNTYLYVDEAHAIGVYGQNGLGIAERDNLIAEIDLLVGTFGKALASVGAYAVCNQVLKECLINQMRPLIFSTALPPFNVAWTYFIFERLPQFSKERSHLEQLSAFLRREVAHRTQIMPSETCIVPYILGGNEATLAKAEYLQGQGYYCLPIGPPTVPKNTSRIRLSLTADMTTDEVRQFAACL

SEQ ID NO: 6971 - DNA, 312 bp, Neisseria gonorrhoeae; identical to SEQ ID NO: 137

SEQ ID NO: 6972 - protein, 104 aa, Neisseria gonorrhoeae; identical to SEQ ID NO: 138

SEQ ID NO: 6973 - DNA, 999 bp, Neisseria gonorrhoeae
ttgagaatttgggaagcgcatccgccgtccgccttgttttcgcgccgaccgcaaccatatagccgccatccgaacaatcagtcagagaaaatcatgaatcaaaccgccatcaaccgcgccgatgcgcgtacccgctttatcttcgacgatatgcccgtgcgcgggctgcacgtccgtctggaaaacgtgtggcaccacattgtaaaacagaaaaactatcccgccgccatccgctgcgccttgggagagctactggctgccggcgttctgctgtcgggcaaccttaaaaacgaaggcacgctgattgtgcaggttcaggggcagggaaaactgaaaatgctggttgcggaagcgacttccgaccgtaccgtccgtgcaaccgcgcggtgggacgaaaccgcagaaatagccgatgacgaaagcctcggcgaccttttgggcggcaacggcgtgttcgtattgacgctgcaacccaaagacggcgaaccctggcagggcgtagtgcctttggaaggcggcagcatcgcgcaaatgttggtgaactatatgaaacgttccgaacagcttgatacgcacatcgccctgtctgcaagcgatgaagcggcgggcgggctgctggtgcagcgtctgcctgaagaggtgttggatgaagaggcatgggaacacgtcagtacgctggcgcgcacgctgacggcggaggagctggcagaattggacgcgcaacacgttttataccgcctgttccacgaaacgccgccgcgcgtgttcgagccggaaacgtttgaatcctcatgtacctgttctcggggcaaggtcagcgatatgctgttgatgctgggcggggaagaagtcggcggcgtggtggcggaacaaggcagcatcgaagtcgattgcgacttctgccacagcaaatacgtgtttgatgaaaccgatgtcaacgcgctgttcggggaggatgtggtcggcgttgccaaagggctgccccgacataccgtccaa

SEQ ID NO: 6974 - protein, 333 aa, Neisseria gonorrhoeae
LRIWEAHPPSALFSRRPQPYSRHPNNQSEKIMNQTAINRADARTRFIFDDMPVRGLHVRLENVWHHIVKQKNYPAAIRCALGELLAAGVLLSGNLKNEGTLIVQVQGQGKLKMLVAEATSDRTVRATARWDETAEIADDESLGDLLGGNGVFVLTLQPKDGEPWQGVVPLEGGSIAQMLVNYMKRSEQLDTHIALSASDEAAGGLLVQRLPEEVLDEEAWEHVSTLARTLTAEELAELDAQHVLYRLFHETPPRVFEPETFESSCTCSRGKVSDMLLMLGGEEVGGVVAEQGSIEVDCDFCHSKYVFDETDVNALFGEDVVGVAKGLPRHTVQ

SEQ ID NO: 6975 - DNA, 135 bp, Neisseria gonorrhoeae
ttgatgaatcaaatccggaatcgaacgatattgattttgcgcgccgagttgttcaagctgttgtctaaaaactttcattatgatgtaaatattcctgagttaaagcctgaagcaacccagcatcaaacaatcaag

SEQ ID NO: 6976 - protein, 45 aa, Neisseria gonorrhoeae
LMNQIRNRTILILRAELFKLLSKNFHYDVNIPELKPEATQHQTIK

SEQ ID NO: 6977 - DNA, 369 bp, Neisseria gonorrhoeae
tttgatttcgactttagcgcctgctgcttccagttgtttttggatgtcttcggcttcagctttagaaacaccctctttaatggttttaggtgcgccgtcaacgatgtctttagcttctttcagacccaaaccagtaattgcacggacaactttaatcacgccgactttttgatcgccggcagaagccaaaacgacatcaaattcggttttttcttcagcatcggcagcaccggcaccagcaggacctgcaactgcaacagcagcagcagaaacaccgaatttttcttcaaaagctttaaccaggtcattcaattccattacggtcaaagaaccaactgcttccaaaatgtcttctttagtaatagccat

SEQ ID NO: 6978 - protein, 123 aa, Neisseria gonorrhoeae
FDFDFSACCFQLFLDVFGFSFRNTLFNGFRCAVNDVFSFFQTQTSNCTDNFNHADFLIAGRSQNDIKFGFFFSIGSTGTSRTCNCNSSSRNTEFFFKSFNQVIQFHYGQRTNCFQNVFFSNSH

SEQ ID NO: 6979 - DNA, 333 bp, Neisseria gonorrhoeae
ttgcgaaattggaagcgatgtaaatttgaaatgcaggccggatattcgtatccgacaaaaaaaacatttgacgcgtttatcgtttccgaaaaaccgctgttggaaatgtcggattcgagaatccgacctacggcaaaaaaccgtagcaaggacaaggcaaatagttgtctgaaaacgggaagggcaattttgccgcagccgccgccgtcattcccgcgaacctacattccgtcattcccacgaaagtgggaatccggaacgcaaaatctaaagaaaccgttttatccgataagtttccgcaccgacaggtctggattcccgcttatgcgggaa

SEQ ID NO: 6980 - protein, 111 aa, Neisseria gonorrhoeae
LRNWKRCKFEMQAGYSYPTKKTFDAFIVSEKPLLEMSDSRIRPTAKNRSKDKANSCLKTGRAILPQPPPSFPRTYIPSFPRKWESGTQNLKKPFYPISFRTDRSGFPLMRE

SEQ ID NO: 6981 - DNA, 360 bp, Neisseria gonorrhoeae
ttgtttttggatgtcttcggcttcagctttagaaacaccctctttaatggttttaggtgcgccgtcaacgatgtctttagcttctttcagacccaaaccagtaattgcacggacaactttaatcacgccgactttttgatcgccggcagaagccaaaacgacatcaaattcggttttttcttcagcatcggcagcaccggcaccagcaggacctgcaactgcaacagcagcagcagaaacaccgaatttttcttcaaaagctttaaccaggtcattcaattccattacggtcaaagaaccaactgcttccaaaatgtcttctttagtaatagccatgctattttactccaaatattgtat

SEQ ID NO: 6982 - protein, 120 aa, Neisseria gonorrhoeae
LFLDVFGFSFRNTLFNGFRCAVNDVFSFFQTQTSNCTDNFNHADFLIAGRSQNDIKFGFFFSIGSTGTSRTCNCNSSSRNTEFFFKSFNQVIQFHYGQRTNCFQNVFFSNSHAILLQILY

SEQ ID NO: 6983 - DNA, 180 bp, Neisseria gonorrhoeae
ttgtgcgaaaatatgcgcttcggtacagtgcggacggattgggtaatggcaacggaaacaaatatcgcggaaatttccgccttggattatgaaggcaggggtgtggcaaaggtcggcggcaaaacgattttcattaaaggggcattacttgattgtttgatgctgggttgcttcaggctt

SEQ ID NO: 6984 - protein, 60 aa, Neisseria gonorrhoeae
LCENMRFGTVRTDWVMATETNIAEISALDYEGRGVAKVGGKTIFIKGALLDCLMLGCFRL

SEQ ID NO: 6985 - DNA, 1074 bp, Neisseria gonorrhoeae
atgatttgccgaaaacctatcggacacacaccatattttgatatgaataaaacaatctgccgcactgccgcactattgataagcggtttttcatacgcaaacaccgtcattcccgatgtctcccccgtcgcacaaggtcaacatgtcttcattaacatccctcagcaacgcctgttcctctacaccgacggcaaactgaccaaggtttatcccgttgcagtaggtcgggcgatgacacaaaccaatctaggcgaacataaaatcggggcgaaagcctataaccctgtttggcacatcccaaaatccatacagaaagaacgcggcgacggcgtaaaaaccatagccgccggtccggacaaccctttggggccggtttttgtccgcttaggagacccgaaactcggtttgggcatacacggaaccaatgcaccggccagcgtcccgggcatccggagtcacggctgcgtccgcatgaaatcgcccgacgcgctcgagtttgccaaaaccatcgccaccggctcgcccgcctccgtcatctatcaaatggcgggcctcaatgaagatgcggatcgcaacctgtggcttgccgccttccgcgacccttacggtaagaacaaccttgacaccgcctccctgaaaaaaagcatcgggcaatgggcaaaaacacagggcaaaaccatcgcgcccgagaaagtcgatgccgtactcaaagaccgcaccggatcggccgtctgtctgacctgcggcaaaaacggcaagatgaagatgccgctcaaatcgctggcgtggatacagggttcttcctcatacagccaagctgaagtcattgaacaaactgaggaaaccaactctgccgaagtatccgagacacgcacgcccgaagtgcctgatgtacacacgcccgaggcacaagcgcatttaaatacccaatccgacggcacgccgactgcctataccgaaccggctgccgattcatcgccgcaagtagaatcacctgatcaggctgcttccgagccggttgatgtattattttcaatagatgtgatacggcaggggaatttgcgtttaggtaat

SEQ ID NO: 6986 - protein, 358 aa, Neisseria gonorrhoeae
MICRKPIGHTPYFDMNKTICRTAALLISGFSYANTVIPDVSPVAQGQHVFINIPQQRLFLYTDGKLTKVYPVAVGRAMTQTNLGEHKIGAKAYNPVWHIPKSIQKERGDGVKTIAAGPDNPLGPVFVRLGDPKLGLGIHGTNAPASVPGIRSHGCVRMKSPDALEFAKTIATGSPASVIYQMAGLNEDADRNLWLAAFRDPYGKNNLDTASLKKSIGQWAKTQGKTIAPEKVDAVLKDRTGSAVCLTCGKNGKMKMPLKSLAWIQGSSSYSQAEVIEQTEETNSAEVSETRTPEVPDVHTPEAQAHLNTQSDGTPTAYTEPAADSSPQVESPDQAASEPVDVLFSIDVIRQGNLRLGN

SEQ ID NO: 6987 - DNA, 498 bp, Neisseria gonorrhoeae
agcagcttcttcgccggcttttttctctgccaaagcagccaaaccgcgcgcaaagcccgatacaggagcttgcataacgaacaacagtttggacaacagctcttcgcggctcggaatagaagccaactcagcaacctgagcagcattcattacttcgccattgtaagaaccggctttaacgacaattttgtcatcttttttcgcgaattggtgcaacactttagcagcagcaacagcatcttcagaagcagcgtaaaccaacggaccaaccatttgatcggccaattctacaaatgaagtaccttgcactgcgcgacgagccagagtatttttcagaacgcgcaaataaacgccttctttacgtgcattcgcacgaagctcagtcatactggaaacactgataccgcgatattcagcgactacgagggtttgagcattagcaattgccgcgctaatttcctcgaccgccactttcttggtttcaatattgagactcaa

SEQ ID NO: 6988 - protein, 98 aa, Neisseria gonorrhoeae
SSFFAGFFLCQSSQTARKARYRSLHNEQQFGQQLFAARNRSQLSNLSSIHYFAIVRTGFNDNFVIFFRELVQHFSSSNSIFRSSVNQRTNHLIGQFYK

SEQ ID NO: 6989 - DNA, 2205 bp, Neisseria gonorrhoeae
atgtttcccgaccaatccgcccccaatctgctgcaaggcttgaaccccgaacaactctccgccgtaacctggccgccgcaatccgccctcgttttggcaggcgcaggcagcggcaaaacgcgcgtgctgaccacgcgtatcgcatggcttttgcaaagcggacaagccagcgtacacagcattatggcggtaacgtttaccaacaaggccgccaaagagatgcaaacccgactcggcgcaatgattcccatcaacgtccgcgctatgtggctcggcacgttccacggtttgtgccaccgctttttgcgcctgcaccaccgcgacgcaggcctgccgtcttcctttcaaatcctcgacagcggcgaccagctttccctcatcaaacgcctgctcaaaagcctcaacatcgccgaagaaatcatcgcgccgcgttcgctgcaaggctttatcaacgcgcaaaaagaatccggtttgcgcgcttccgtcttgggcgcgcccgatccgcacacaagccgcatgattgggtgctacgccgaatacgacaaaatctgccaacgcgaaggcgtggtcgatttcgccgaactcatgctccgcagctacgaaatgctgcaaagtaacgaaatcctgcgccggcactaccaaaaccgcttcaaccacattctggtcgacgagtttcaagacaccaacaaactgcaatacgcctggctcaaactcatggcgggcggtaacgcagcggtatttgccgtcggcgacgacgaccaaagcatttaccgcttccgcggcgcaaacgtcggcaacatgaccgcactgatggaagaattccacatcgacgcgcccgtcaaactcgaacaaaactaccgctccgtcggcaacatcctcgccgccgccaacgccgttatcgaaaacaacgacgaacgtctcggcaaaaacctgcgcaccgacgccgaagcaggcgacaaaatccgctactactccgcctttaccgacctcgaagaagcccggttcatcgtggatgaaaccaaagccctcgaacgcgaaggctgggatttggacgaaatcgccgtcctctaccgcagcaacgcccaatcgcgcgtcatcgaacaaagcctgttccgcagcggcatcccctacaaaatctacggcggcctgcgcttttacgaacgccaagaaatcaaacacgccctcgcctacctgcgcctcgccgtcaatcccgacgacgacaacgccctcttgcgtgtcatcaacttcccaccgcgcggcatcggcgcgcgcaccgtcgaaaaccttcagacggcctcaaacgaacaaggcatcaccctctggcaggcagcctgcaacgccggcgcgaaagccgccaaagtcgtcgccttcgtccgcctgattgaagccctgcgcaaccaagtcggacaaatgcacctgtccgaaatcatcgtcggcatcctcaaagacagcggtctgaccgagcactaccgaacccaaaaaggcgacaaccaagaccgcctcgacaaccttgacgaactcgtcaacgccgccatcgagttcaaacccgaagacagcaactttgaaaccctgcccgaaaacatttcagacgatcccgccttccccatcctcgccttcttgagcaacgccgccctcgaatccggcgaaaaccaagcaggggcaggcgaaaaagccgtccaactgatgaccgtccacgccgccaaaggcttggaattcaacgccgtcttcctcaccggtatggaagaggggcgtttccccagcgaaatgagccttgccgagcgcggcggcctcgaagaagaacgccgcctcatgtacgtcgccatcacccgcgcccgcaaacgcctctacatcaccatggcacagcaacgcatgctgcacggacaaacccaattcggcatcgcatcccgcttcgtcgaagaaatcccgccagaagtattgcactacctgtccgtcaaaaaacccgccttcgacagctacggcaacacgcgccaaaccaccgtacaacgggacaaaatcatcgatgacttcaaacagccgcaaacctacgcaggcttccgcatcggacaaaacgtccgtcacgccaaattcggcaccggcgtgattatcgatgccgcagacaaaggcgaatccgcccgactgaccatcaacttcggcaaacagggcgtgaaagagctggataccaagtttgcgaaattggaagcgatg

SEQ ID NO: 6990 - protein, 735 aa, Neisseria gonorrhoeae
MFPDQSAPNLLQGLNPEQLSAVTWPPQSALVLAGAGSGKTRVLTTRIAWLLQSGQASVHSIMAVTFTNKAAKEMQTRLGAMIPINVRAMWLGTFHGLCHRFLRLHHRDAGLPSSFQILDSGDQLSLIKRLLKSLNIAEEIIAPRSLQGFINAQKESGLRASVLGAPDPHTSRMIGCYAEYDKICQREGVVDFAELMLRSYEMLQSNEILRRHYQNRFNHILVDEFQDTNKLQYAWLKLMAGGNAAVFAVGDDDQSIYRFRGANVGNMTALMEEFHIDAPVKLEQNYRSVGNILAAANAVIENNDERLGKNLRTDAEAGDKIRYYSAFTDLEEARFIVDETKALEREGWDLDEIAVLYRSNAQSRVIEQSLFRSGIPYKIYGGLRFYERQEIKHALAYLRLAVNPDDDNALLRVINFPPRGIGARTVENLQTASNEQGITLWQAACNAGAKAAKVVAFVRLIEALRNQVGQMHLSEIIVGILKDSGLTEHYRTQKGDNQDRLDNLDELVNAAIEFKPEDSNFETLPENISDDPAFPILAFLSNAALESGENQAGAGEKAVQLMTVHAAKGLEFNAVFLTGMEEGRFPSEMSLAERGGLEEERRLMYVAITRARKRLYITMAQQRMLHGQTQFGIASRFVEEIPPEVLHYLSVKKPAFDSYGNTRQTTVQRDKIIDDFKQPQTYAGFRIGQNVRHAKFGTGVIIDAADKGESARLTINFGKQGVKELDTKFAKLEAM

SEQ ID NO: 6991 - DNA, 96 bp, Neisseria gonorrhoeae
ttgtttggcttttcctacaccgccgccctgccgctttctgcaacatccaagcgcacaaatatgccgtctgaaggctttagacggcatatttcacga

SEQ ID NO: 6992 - protein, 32 aa, Neisseria gonorrhoeae
LFGFSYTAALPLSATSKRTNMPSEGFRRHISR

SEQ ID NO: 6993 - DNA, 447 bp, Neisseria gonorrhoeae; identical to SEQ ID NO: 141

SEQ ID NO: 6994 - protein, 149 aa, Neisseria gonorrhoeae; identical to SEQ ID NO: 142

SEQ ID NO: 6995 - DNA, 693 bp, Neisseria gonorrhoeae
gttattcacgcttgatgtatcaacgcgaacacctaaacccatagtgctggatacagcaacttttttcaggtactgacctttagcagcagcaggtttggctttaacgatagcgtccagcaacgcatcaaagttctctttcaaatcagcttcagcgaatgaagcacgaccaatcgttgcatgaacaatacctgccttgtcggtacggtactgcacttgacctgcttttgcattttttaccgcttcggcaacattaggggtaaccgtacctattttagggtttggcatcagaccacgaggacccaagatggtacccaattgaccaacgatacgcattgcatcaggagaagcaataacaacatcaaagttcagattgcctgctttgatttcagcagccaaatcttcgaaaccgacgacatccgcaccagcctctttagcagcttctgcatttacaccttgagtaaatacagccacacgggttgtcttaccagtacctttaggcagaacgactgaaccacggataacttggtcagatttacgagaatcaacgcccaagttgaaagatacgtcaacagattcgtcaaatttagcggtagcagcttttttaaccaaggcaattgcttcgtcgattgcgtacagtttgttagcttcaacagaagagcgaagaactttcaagcgtttagatactttagccat

SEQ ID NO: 6996 - protein, 4 aa, Neisseria gonorrhoeae
VIHA

SEQ ID NO: 6997 - DNA, 93 bp, Neisseria gonorrhoeae
ttgggcgactattatcgtgaaatatgccgtctaaagccttcagacggcatatttgtgcgcttggatgttgcagaaagcggcagggcggcggtg

SEQ ID NO: 6998 - protein, 31 aa, Neisseria gonorrhoeae
LGDYYREICRLKPSDGIFVRLDVAESGRAAV

SEQ ID NO: 6999 - DNA, 432 bp, Neisseria gonorrhoeae
tacaacaccctccacgtccaagcccattgagcgagcagaacctgctatagtacgaacagccgcatccaagtcagcagcagtcaaatcaggctctttagttttagcaatttcttccaactgggcacgggtcaatttacctaccttgtttgtcagaggattagaactacctttttgcaaaccggcggcttttttcaacagaatagaagccggaggagttttcatcacaaatgtgaatgatttatctgcaaatgcagtaatcacaaccggaattggcaaaccagattccataccttgggttgcagcattaaatgctttacagaattccatgatattcaaaccacgttgacccaaagcaggaccaactgggggggatggattggctttgcctgcaggaatttgcagtttaatatagccgataattttctttgccac

SEQ ID NO: 7000 - protein, 9 aa, Neisseria gonorrhoeae
YNTLHVQAH

SEQ ID NO: 7001 - DNA, 1464 bp, Neisseria gonorrhoeae
atgatgaaattgggtttcaaaccgatacccctcgccattgccgcagtattgtgcgccctggttttggcactgcccgtacccgacggggtcaagcctcaggcttggacgctgctggctatgtttgtcggtgtgattgccgccattatcggcaaggttatgccgttgggcgcgctgtcgattattgccgtcgggttggtcgcagtaaccggcgtaaccgccgacaaaccgggcgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaattatcattccaatcccatttcgtcggctatgtttattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatattttttgtatccgcctgaaattaaagaaacgcccaatgctgttcaatttgccaaagaccgtctgagcgagatgggtaaaatgtcggcagacgaaatcattatggcggtcattttcggtatcttgctgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttctcgctgctgccgtttcactgaatgccccggcgatgccgactgcgctgatgatggcggccgcatccaacattatgatgaccctcactcattatgcgaccggtacttcacctgtgattttcggctcgggctacaccacaatgggagaatggtggaaggcgggttttatcatgagcgtagtcaattttctgattttttccgttatcggcagcatttggtggaaagttctgggatattgg

SEQ ID NO: 7002 - protein, 488 aa, Neisseria gonorrhoeae
MMKLGFKPIPLAIAAVLCALVLALPVPDGVKPQAWTLLAMFVGVIAAIIGKVMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLSEMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFLAAAVSLNAPAMPTALMMAAASNIMMTLTHYATGTSPVIFGSGYTTMGEWWKAGFIMSVVNFLIFSVIGSIWWKVLGYW

SEQ ID NO: 7003 - DNA, 2688 bp, Neisseria gonorrhoeae
atgtccgaccaccgcctcgacaccgcccgccgccattccctgttcctcgcccgccagctcgacaacggcaaactcaagcccgaaattttcctgcccatgttggacaaggcgttgacggatgagggtttccaagcctttgccgactgggacaaaatccgcgcggaagaaagcgaggaagaattggcgcggcagttgcgcgagttgcgccgttatgtggtgtcgcagattatcgtgcgcgatataaaccgcatcagcgatttgaacgaagttacccgcacgattacgctgtttgccgattttgccgtcaataccgcgctggatttcgcctacgcctattatcgggacatgtacggcacgccgatcgggcgttataccaaatcgccgcagcatttgagcgtggtggcgatgggcaaggcgggcggctatgagttgaacgtgtcttccgacatcgatttgattttcgtctatcccgaatcgggcgacaccgacggcaggcgcgaacgggggaatcaggagtttttcaccaaagtcgggcagaaactgattgcattgttgaacggcattactgccgacgggcaggtgttccgcgtcgatatgcggctgcggccggacggtgattcgggcgcgttggtattgagcgaaaccgtgctggagcaatatctgattacgcaggggcgcgaatgggaacgctatgcgtggtgcaaaggccgcgtagtcacgccgtatccgaacgacatcaaatcgctggtgcgccccttcgtgttccgcaaatatctggattacggcgcgtatgaggcgatgcgcaacctgcaccgccaaatccgcagcgaagtcagcaaaaaaggcatggcggacaacatcaaactcggcgcgggcggcatccgcgaggttgaatttatcgcccagattttccagatgatacgcggcggccaaatgcgcgcgctgcaactgaaaggcacgcaggaaacgctgaagaaaattgccgagatgggcattatgccgtctgaaaacgtcgaaaccctgcttgccgcctaccgcttcctgcgcgatgtcgaacaccgcctgcaatactgggacgaccggcaaacccaaaccctgccgatctcgcccgaacagcggcaactgctcgccgaaagcatgggtttcgacagttatgccgctttttcagacggcctcaatgttcatcggaacaaagtcaatcagttgttcaacgaaatcttgagcgaacctgaagaacaagcgcaaagcaatagcgaatggcaatgggcatggcaggaaaaacccgacgaagaagaacggctaggccgtctgaaagaacacgggttcgatgccgaagccgtcaccgcaaggctcgaacaaatctgccacggacataaataccgccgcctttccgcacacgcccagccgcgctttgacaccattgtgccgctgtttgtacaggcggcggcagagcaaaacaacccgacagatacgctgatgcggctgttggattttctcgaaaacatcagcctccgctccgcctatctcgccttcctcaacgaacatccgcaaaccttggcacaactggcgcagattatgagccaaagctcgtgggtggcggcgtatctgaacaaatatccgattttgttggacgaactcatcagcgcgcagcttttggataccgcgtttgattggcaggcactcgccgccgccctttcagacggcatcgaagcctgcggcggcgataccgaagcgcaaatggacacgctgcgccatttccaacacgcccaagtcttccgcctcgccgtccaagacctcgccggattgtggacggtagaatccctctctgaccaactctccgccctcgccgacaccgtcattgccgccgccctttcgtgcgcgtgggcggatatgcccaaaaaacaccgcgacaccccgcaattcgccgtcatcggctacggcaagctcggcggcaaagaactcggctacgcctccgacctcgacttagtctatctttacgacgatccccatcccgaagcaggcgacgtgtacagccgcctcgcccgccgcctgaccaaccggctttccgccgccaccggcgcgggcagcctctacgaaaccgacctgcgcctgcgccctaatggcgacgccggtttcctcgcgcacagcatcgccgcctttggaaaataccagcgtgaaaacgcatggacatgggaacaccagtccctcacccgcgcccgcttcatctgcggcacacccgaaattcagacggcattcgaccgcatccgcaccgaaatgctgactgccgaacgcgaccaaaccgccttggcaggcgaaatcatcgaaatgcgcgaaaaaatgttccccacccatccgcctgccgacagcaacgtcaaatacgcgcgcggcggcgtggtcgacgtcgaatttatcgtccaatatctgatacttgcccatgcccgccagtatccgcaactcttggacaactacggcaacatcgccctattgaacatcgccgccgactgcggtttgattgacaaaaccctcgccggacaaagccgcaccgcctaccgcctctaccgccggcagcagcacaacaccaaattgcgcgacgcggcaaaaaccgaagtaagcgacgaattgctgtcccattacggcaatgtcaggaaattgtggcgggaagtgttcggggaggaagcggcaaccgcc

SEQ ID NO: 7004 - protein, 896 aa, Neisseria gonorrhoeae
MSDHRLDTARRHSLFLARQLDNGKLKPEIFLPMLDKALTDEGFQAFADWDKIRAEESEEELARQLRELRRYVVSQIIVRDINRISDLNEVTRTITLFADFAVNTALDFAYAYYRDMYGTPIGRYTKSPQHLSVVAMGKAGGYELNVSSDIDLIFVYPESGDTDGRRERGNQEFFTKVGQKLIALLNGITADGQVFRVDMRLRPDGDSGALVLSETVLEQYLITQGREWERYAWCKGRVVTPYPNDIKSLVRPFVFRKYLDYGAYEAMRNLHRQIRSEVSKKGMADNIKLGAGGIREVEFIAQIFQMIRGGQMRALQLKGTQETLKKIAEMGIMPSENVETLLAAYRFLRDVEHRLQYWDDRQTQTLPISPEQRQLLAESMGFDSYAAFSDGLNVHRNKVNQLFNEILSEPEEQAQSNSEWQWAWQEKPDEEERLGRLKEHGFDAEAVTARLEQICHGHKYRRLSAHAQPRFDTIVPLFVQAAAEQNNPTDTLMRLLDFLENISLRSAYLAFLNEHPQTLAQLAQIMSQSSWVAAYLNKYPILLDELISAQLLDTAFDWQALAAALSDGIEACGGDTEAQMDTLRHFQHAQVFRLAVQDLAGLWTVESLSDQLSALADTVIAAALSCAWADMPKKHRDTPQFAVIGYGKLGGKELGYASDLDLVYLYDDPHPEAGDVYSRLARRLTNRLSAATGAGSLYETDLRLRPNGDAGFLAHSIAAFGKYQRENAWTWEHQSLTRARFICGTPEIQTAFDRIRTEMLTAERDQTALAGEIIEMREKMFPTHPPADSNVKYARGGVVDVEFIVQYLILAHARQYPQLLDNYGNIALLNIAADCGLIDKTLAGQSRTAYRLYRRQQHNTKLRDAAKTEVSDELLSHYGNVRKLWREVFGEEAATA

SEQ ID NO: 7005 - DNA, 921 bp, Neisseria gonorrhoeae
atgcaatacagcacactggcaggacaaaccgacaactccctcgtttccaataatttcgggtttttgcgcctgccgcttaattttatgccgtatgaaagccatgccgattgggttattaccggcgtgccttatgatatggcggtttcagggcgttccggcgcgcgtttcggtcctgaagccatccggcgcgcctccgtcaacctcgcttgggagcaccgcaggtttccgtggacatttgatgtgcgcgaacgcctgaacattattgattgcggcgacttggttttttcttttggcgacagcagggattttgtcgaaaaaatggaagcgcacgccggcaaattactttctttcggcaaacgctgtttgagtttgggcggcgaccatttcattaccctcccgttgttgcgcgcccacgcccgctatttcggcaaactcgcactgattcattttgacgcgcacaccgacacctacgacaacggcagcgaatacgaccacggcacgatgttttataccgcccccaaggaaggcctcatcgacccgtcccgttccgtacaaatcggcatacgcaccgaacacagtaaaaaattgccttttactgtgttgtccgcccccaaagtcaatgaagacagtgttgaagagaccgtccgtaaaatcaaagaaaccgtcggcaatatgcccgtttacctgactttcgacatagactgtctcgacccgtcgttcgcccccgggaccggtacgcccgtatgcggcggcttgagcagcgacagggcattaaaaatcctacgtgggctgacggatctcgacatcgtcggtatggatgttgtagaagttgccccctcttacgaccaatccgacattaccgctttggccggcgccacaattgccttggaaatgctttaccttcaaggtgcgaaaaaggac

SEQ ID NO: 7006 - protein, 307 aa, Neisseria gonorrhoeae
MQYSTLAGQTDNSLVSNNFGFLRLPLNFMPYESHADWVITGVPYDMAVSGRSGARFGPEAIRRASVNLAWEHRRFPWTFDVRERLNIIDCGDLVFSFGDSRDFVEKMEAHAGKLLSFGKRCLSLGGDHFITLPLLRAHARYFGKLALIHFDAHTDTYDNGSEYDHGTMFYTAPKEGLIDPSRSVQIGIRTEHSKKLPFTVLSAPKVNEDSVEETVRKIKETVGNMPVYLTFDIDCLDPSFAPGTGTPVCGGLSSDRALKILRGLTDLDIVGMDVVEVAPSYDQSDITALAGATIALEMLYLQGAKKD

SEQ ID NO: 7007 - DNA, 111 bp, Neisseria gonorrhoeae
gtggcgaggtttgaacgggaaacggcggcatttgccgctgtttttttatcggcaggcatccgtccgaatatcggggcaaggtttcagacggcatcgaaggttgctatgata

SEQ ID NO: 7008 - protein, 37 aa, Neisseria gonorrhoeae
VARFERETAAFAAVFLSAGIRPNIGARFQTASKVAMI

SEQ ID NO: 7009 - DNA, 111 bp, Neisseria gonorrhoeae; identical to SEQ ID NO: 3865

SEQ ID NO: 7010 - protein, 37 aa, Neisseria gonorrhoeae; identical to SEQ ID NO: 3866

SEQ ID NO: 7011 - DNA, 534 bp, Neisseria gonorrhoeae
gttaatcttctcaacctggctgaactccagctcaacgggtgtttctctaccaaatatctgaacagacacgcgtaacttattccgttcataattgacctcctcaaccaccccgttaaaatccgcaaacggtccttcatttacacgaacctgttgaccgacctcaaattcaacttttggtttcggcttctctatgccggtctgaacctgctgtaaaataatttcagcctctctctgactaatcggcgtgggtctattagccctccctccaataaaaccagaaacacggggagtgctttttacaagatgccaagagtcatctgtcatttccatctcaactaacacataaccaggatatgactttctttcactaatagtcttacgaccattgcggatatcaacaactttctctacaggcaccagaatttgtccgaaataatctcccatctcctcacgggcaattcgctcttccaatattcgttggacattcttctcaaaccccgaatacgcctgtacaacataccattttttcgacat

SEQ ID NO: 7012 - protein, 24 aa, Neisseria gonorrhoeae
VNLLNLAELQLNGCFSTKYLNRHA

SEQ ID NO: 7013 - DNA, 1890 bp, Neisseria gonorrhoeae
atgcctatccttaccatccgtgaagtgtgcaacattaatcattggagcataggttattatgatgttgacgattccggcgaaatcatcgtccgccccaatccctcgcaacacaatcaaactgtttcactgcaaaaactgactgaagccgtgcaacaaaaacatcaggcgcgcctgcctgttttgttttgttttccgcaaatcctcgaacaccgcctccgcgacattaaccgcgcctttcagacggcacgggaagagtgcggctataagggcggttattgtttggtttaccctatcaaggtcaaccaacaccgccgcgtcatcgagtcgcttatgtcaagcggacaaccgcatggtttggaagccggttctaaagccgaactgatggcggttttggcacacgccggcacccggcaaacattaatcgtctgcaacggctataaagaccgtgaatatatccgtttcgccttgatgggcgaaaaactggggcatcaggtttatttggtgattgagaagctgtccgaaatacaaatggtattggaagaggcggaaaaactcggcatcaagccccgtttgggtgtgcgcgccagactggcttcccaaggttcgggaaaatggcagtcttcgggtggggaaaaatcaaaattcggcttgtcggcttcccaagttttgcaactggtcgatattttgaaacaaaaaaacaggctggactgcctgcagcttttgcatttccatttgggctcgcagcttgggaacatccgtgatgttgccacaggtgtacacgaatcggctcggttttatgttgagttgcacaaactgggggtaaatatccgctgttttgatgtaggtggcgggcttggcgtggattacgaaggaaaccgcacacaatcggattgttccgttaattacagcctgaacgaatatgccgccacagtcgtatggggcatcagtcaggcttgtctcgaacacgggctgccgcatccgacaatcattaccgagagcgggcgcggcattaccgcacatcacgccgttttggttgctaatgttataggcgttgaacgttacaaaccgcgtcggctggatgcgccatcgcccgaagcaccgcgtgtgttgcacagtatgtgggaaacttggacggatatttccgcctcgcgggaaaaacgttccttacgcagctggatacacgaagggcagtttgatcttgccgatgtgcataatcagtataatgtcgggctgttgagtttggcgcaacgtgcgtgggcggagcaactgtatttaaatatctgtcatgaagtcggcgaattgtttaatgaaaaacaccggtctcaccgaaccattattgacgaattgcaagaacgttttgccgataagctgtatgtcaatttctcactcttccaatctttgcccgatgcttggggcatagatcaacttttccctgtttgtcctattaccggtttgaatgaaccgattgcgcgccgcgccgtgttgttggacattacctgcgattcagacggtacgattgaccactacatcgacggcgacggcatcgccggtacgatgcctatgcctgattatcccgaagaagagccgccgtttttaggcttttttatggtgggagcatatcaggaaatactcggcaatatgcacaatcttttcggcgacactgccactgctgatgttgttgtaagggaagacggacaatttaccgtcatcgattacgatgaaggaaacaccgttgccgatatgctcgaatacgtttatcaagatccgaaagagctgatgaaacgctatcgcgaacaaatcgaacattcagaccttcctgcctcgcaggctatgtctttcttaaaagaactcgaagcggggcttaatggttatacctatttggaagacgaa

SEQ ID NO: 7014 - protein, 630 aa, Neisseria gonorrhoeae
MPILTIREVCNINHWSIGYYDVDDSGEIIVRPNPSQHNQTVSLQKLTEAVQQKHQARLPVLFCFPQILEHRLRDINRAFQTAREECGYKGGYCLVYPIKVNQHRRVIESLMSSGQPHGLEAGSKAELMAVLAHAGTRQTLIVCNGYKDREYIRFALMGEKLGHQVYLVIEKLSEIQMVLEEAEKLGIKPRLGVRARLASQGSGKWQSSGGEKSKFGLSASQVLQLVDILKQKNRLDCLQLLHFHLGSQLGNIRDVATGVHESARFYVELHKLGVNIRCFDVGGGLGVDYEGNRTQSDCSVNYSLNEYAATVVWGISQACLEHGLPHPTIITESGRGITAHHAVLVANVIGVERYKPRRLDAPSPEAPRVLHSMWETWTDISASREKRSLRSWIHEGQFDLADVHNQYNVGLLSLAQRAWAEQLYLNICHEVGELFNEKHRSHRTIIDELQERFADKLYVNFSLFQSLPDAWGIDQLFPVCPITGLNEPIARRAVLLDITCDSDGTIDHYIDGDGIAGTMPMPDYPEEEPPFLGFFMVGAYQEILGNMHNLFGDTATADVVVREDGQFTVIDYDEGNTVADMLEYVYQDPKELMKRYREQIEHSDLPASQAMSFLKELEAGLNGYTYLEDE

SEQ ID NO: 7015 - DNA, 276 bp, Neisseria gonorrhoeae
accttcccttctcagcaatacatcaaaaaataaccacgaaattgctgtatctgccgcatagataaatatagaaagcacagcaacaaacactataacaaatacagtcattctgacggcatcttcacgcttaggccaaaccacctttttgaattcggaccaagaatttgagaaatatgcaaaaaaaccctccttaccggaattagatgcagattctttatcttgaacaaccagttgattcactttaacattctttttttcaggcgtatgttctgtcat

SEQ ID NO: 7016 - protein, 10 aa, Neisseria gonorrhoeae
TFPSQQYIKK

SEQ ID NO: 7017 - DNA, 333 bp, Neisseria gonorrhoeae
atgccgtctgaagcgttatccggcgttcagacggcattttgttttccgacagtttataaactgtcgttgtttcttgacagaaacaacgaccttatttatttgaaacgattggaggacatgattatgggtttttggggtagtgtgggaaaagcagcaaaagcagtaggcgagggattgattgaagccggcaatcagcataaggcgttgaaaatggaatatgcggagaaatcaagtgaggagctgcatgaaatcgtaaagagtgatggtttttttaaaaattccacacgggagaaaggtgcggcttatgctgttttaaaagagcgtggcgaggtt

SEQ ID NO: 7018 - protein, 111 aa, Neisseria gonorrhoeae
MPSEALSGVQTAFCFPTVYKLSLFLDRNNDLIYLKRLEDMIMGFWGSVGKAAKAVGEGLIEAGNQHKALKMEYAEKSSEELHEIVKSDGFFKNSTREKGAAYAVLKERGEV

SEQ ID NO: 7019 - DNA, 96 bp, Neisseria gonorrhoeae
atgccgattttgctggatatatcccgagatggcaagggacgaatcgacaccggcacaggtgcggacgatttcggttttcccgatatgcacaaaacc

SEQ ID NO: 7020 - protein, 32 aa, Neisseria gonorrhoeae
MPILLDISRDGKGRIDTGTGADDFGFPDMHKT

SEQ ID NO: 7021 - DNA, 480 bp, Neisseria gonorrhoeae
aggctgtttggcagattcggcagcattttgtatcggcggtgcagtcaatttctgtccgctcaagcgcgcacttttcttcacttccgcacgcaggcggctgttttcgccgcgcaaggacagcagccgcccgaacagggcaaacattccgaacacgatgccgacgacaaacgcgccgaacaatacgacaatcagcggcagattgacactctgccccggaagataggaaaaggtaacggcatccatattaatgacggcaagcagcaggaagagcagcaggataatgattttgatgacggtatagataagtttcatgtttgctccgtaaataaaaacgccgcacggacagcttcgcactctgaaccaagattgcgttagtttaaacgatttgcacggtttcggatagaatgcggcagcgtgttcggacggcatacggagtatgcgattgccgacaattttaccaaatacaccgctcctttccat

SEQ ID NO: 7022 - protein, 124 aa, Neisseria gonorrhoeae
RLFGRFGSILYRRCSQFLSAQARTFLHFRTQAAVFAAQGQQPPEQGKHSEHDADDKRAEQYDNQRQIDTLPRKIGKGNGIHINDGKQQEEQQDNDFDDGIDKFHVCSVNKNAARTASHSEPRLR

SEQ ID NO: 7023 - DNA, 1098 bp, Neisseria gonorrhoeae
ttgagctattggcctctaaacttaagcgataacagaagaaaccacgccggcacccacggtacggccgccttcgcgaatcgcaaagcgcagaccttcttccatagcgataggcgcaatcagttctacagtaatggttacgttctcacccggcattaccatttccacacctttttccaaagtaaccgcgccggttacgtcagtggtacggaagtagaattggggacggtagttggcgaaaaacggggtatggcggccgccctcttctttgctcaatacgtacacttctgctttgaacttggtgtgaggagtgatagtacccggtttggccaatacctgaccgcgttctacgtcttcacgtttggtaccgcgcagcaatacgcctacgttgtcgcccgcctgaccttcgtccagcagtttgcggaacatttcaacgccggtacaggtggttttttgggtttctttcagaccgacgatttcaatctcgtcaccaacgtggatgatacctcgctctacacggccggtgactacggtaccgcggccggaaatggagaacacgtcttcgataggcagcaggaatggtttgtccacggcacgctcgggagtcgggatgtagctgtccaatgcggtagccagttcgaagattttttcttcgtaagcggcatcgccttccaaggctttcagtgcggaaccttgtacgatcgggcagtcgtcgccggggaagtcgtagctggacagcaggtcgcggatttccatttcaaccagttccaacagctcggcatcgtcgaccatgtcgcatttgttcatgaacacgatgatgtaaggtacgcctacttgacgggccagcaggatgtgttcgcgggtttgcggcatagggccgtcggcagcagaacataccaggattgcaccgtccatttgtgcggcgccggtaatcatgtttttaacgtagtcggcgtgacccggacagtctacgtgtgcgtagtggcgggtttcggtttcgtattctacgtgcgaggtgttaatggtaataccgcgtgctttttcttcgggtgcgttgtcgatttggtcgtaagcttttgcagcgccgccgaattttttagc

SEQ ID NO: 7024 - protein, 366 aa, Neisseria gonorrhoeae
LSYWPLNLSDNRRNHAGTHGTAAFANRKAQTFFHSDRRNQFYSNGYVLTRHYHFHTFFQSNRAGYVSGTEVELGTVVGEKRGMAAALFFAQYVHFCFELGVRSDSTRFGQYLTAFYVFTFGTAQQYAYVVARLTFVQQFAEHFNAGTGGFLGFFQTDDFNLVTNVDDTSLYTAGDYGTAAGNGEHVFDRQQEWFVHGTLGSRDVAVQCGSQFEDFFFVSGIAFQGFQCGTLYDRAVVAGEVVAGQQVADFHFNQFQQLGIVDHVAFVHEHDDVRYAYLTGQQDVFAGLRHRAVGSRTYQDCTVHLCGAGNHVFNVVGVTRTVYVCVVAGFGFVFYVRGVNGNTACFFFGCVVDLVVSFCSAAEFFS

SEQ ID NO: 7025 - DNA, 99 bp, Neisseria gonorrhoeae
atgccgtctgaagcgttcagacggcattttgcctgttcctcatcaggtatgaggcaggcttttcttattaaaaaaatgacatttcacgctgatttgtta

SEQ ID NO: 7026 - protein, 33 aa, Neisseria gonorrhoeae
MPSEAFRRHFACSSSGMRQAFLIKKMTFHADLL

SEQ ID NO: 7027 - DNA, 471 bp, Neisseria gonorrhoeae
atgaaccttgatttaaccgctcaaaaagtccgcctttcttggaaggatattctgtgggggtatgagaataaatacttgggttgggctgatgtggcagcttatgcccgaaaaatgacgctttcagatcatgatgaacgcgtgttcaagctatctttaaccaataaatccaatattcttgaattaaagcctgttctagaagatttggcttcggaaacgaggggttattcccctaaaaattggctgtacatcctcctaaatgacgtattccatagaaaggaagaattttacggccctttgggggaagttgaaaaaatttatgcggatttcgattatccggaagaaatagaatcatttgtcaggtatatgccgcccaaagacggttatattccttctgcccacacttatgaagaaaatattgcccggttatattctcactgggaacactatttgaacaacggcggcgggcagggt

SEQ ID NO: 7028 - protein, 157 aa, Neisseria gonorrhoeae
MNLDLTAQKVRLSWKDILWGYENKYLGWADVAAYARKMTLSDHDERVFKLSLTNKSNILELKPVLEDLASETRGYSPKNWLYILLNDVFHRKEEFYGPLGEVEKIYADFDYPEEIESFVRYMPPKDGYIPSAHTYEENIARLYSHWEHYLNNGGGQG

SEQ ID NO: 7029 - DNA, 1182 bp, Neisseria gonorrhoeae
agcgataacagaagaaaccacgccggcacccacggtacggccgccttcgcgaatcgcaaagcgcagaccttcttccatagcgataggcgcaatcagttctacagtaatggttacgttctcacccggcattaccatttccacacctttttccaaagtaaccgcgccggttacgtcagtggtacggaagtagaattggggacggtagttggcgaaaaacggggtatggcggccgccctcttctttgctcaatacgtacacttctgctttgaacttggtgtgaggagtgatagtacccggtttggccaatacctgaccgcgttctacgtcttcacgtttggtaccgcgcagcaatacgcctacgttgtcgcccgcctgaccttcgtccagcagtttgcggaacatttcaacgccggtacaggtggttttttgggtttctttcagaccgacgatttcaatctcgtcaccaacgtggatgatacctcgctctacacggccggtgactacggtaccgcggccggaaatggagaacacgtcttcgataggcagcaggaatggtttgtccacggcacgctcgggagtcgggatgtagctgtccaatgcggtagccagttcgaagattttttcttcgtaagcggcatcgccttccaaggctttcagtgcggaaccttgtacgatcgggcagtcgtcgccggggaagtcgtagctggacagcaggtcgcggatttccatttcaaccagttccaacagctcggcatcgtcgaccatgtcgcatttgttcatgaacacgatgatgtaaggtacgcctacttgacgggccagcaggatgtgttcgcgggtttgcggcatagggccgtcggcagcagaacataccaggattgcaccgtccatttgtgcggcgccggtaatcatgtttttaacgtagtcggcgtgacccggacagtctacgtgtgcgtagtggcgggtttcggtttcgtattctacgtgcgaggtgttaatggtaataccgcgtgctttttcttcgggtgcgttgtcgatttggtcgtaagcttttgcagcgccgccgaattttttagctaaaatagtagtcaaagcggcagtcagggtggttttaccatggtcaacgtgaccgatggtgccaacgtttacgtgcggtttgctacgttcgaatttttccttagccat

SEQ ID NO: 7030 - protein, 358 aa, Neisseria gonorrhoeae
SDNRRNHAGTHGTAAFANRKAQTFFHSDRRNQFYSNGYVLTRHYHFHTFFQSNRAGYVSGTEVELGTVVGEKRGMAAALFFAQYVHFCFELGVRSDSTRFGQYLTAFYVFTFGTAQQYAYVVARLTFVQQFAEHFNAGTGGFLGFFQTDDFNLVTNVDDTSLYTAGDYGTAAGNGEHVFDRQQEWFVHGTLGSRDVAVQCGSQFEDFFFVSGIAFQGFQCGTLYDRAVVAGEVVAGQQVADFHFNQFQQLGIVDHVAFVHEHDDVRYAYLTGQQDVFAGLRHRAVGSRTYQDCTVHLCGAGNHVFNVVGVTRTVYVCVVAGFGFVFYVRGVNGNTACFFFGCVVDLVVSFCSAAEFFS

SEQ ID NO: 7031 - DNA, 351 bp, Neisseria gonorrhoeae
ttgctgtgttttaatggcggtattgaaaaacacatcttgttcaatcaaccgataaaaaaaggactgaaaatgaaaaaactgttattggccgccgttgtttccctaaatgccgcaaccgcatttgccggcgactctgccgagcgtcagatttacggcgatccccattttgaacaaaaccgcacaaaagccgtgaaaatgttggaacagcgcggttatcaggtttacgatgtcgatgccgacgactactggggcaaacctgttttggaagtggaagcctataaagacggccgcgaatacgacatcgtgttgtcttaccccgacctgaaaatcatcaaagagcagctcgatcgc

SEQ ID NO: 7032 - protein, 117 aa, Neisseria gonorrhoeae
LLCFNGGIEKHILFNQPIKKGLKMKKLLLAAVVSLNAATAFAGDSAERQIYGDPHFEQNRTKAVKMLEQRGYQVYDVDADDYWGKPVLEVEAYKDGREYDIVLSYPDLKIIKEQLDR

SEQ ID NO: 7033 - DNA, 99 bp, Neisseria gonorrhoeae
atgccgtctgaacgcacgttttgccgttcagacggcattttcatagattggtatccgactgttgaagaggcaatcagccgtcatttggaagacttttcg

SEQ ID NO: 7034 - protein, 33 aa, Neisseria gonorrhoeae
MPSERTFCRSDGIFIDWYPTVEEAISRHLEDFS

SEQ ID NO: 7035 - DNA, 249 bp, Neisseria gonorrhoeae
tttaaactggataatcttttcgtatttcgccatcaactcgtcatgggtttcgggatgttcttcgtcaatcaggatgcagtccaccgggcaaacctgctggcactgcggctcatcgtagtgtccgacgcactgcgtgcagaggttggggttgatttcgtaaatttcctcgccttgggaaatggcatcattggggcattcgggttcgcatacgtcgcagttgatgcactcgtcggtaataaaaagcgacat

SEQ ID NO: 7036 - protein, 83 aa, Neisseria gonorrhoeae
FKLDNLFVFRHQLVMGFGMFFVNQDAVHRANLLALRLIVVSDALRAEVGVDFVNFLALGNGIIGAFGFAYVAVDALVGNKKRH

SEQ ID NO: 7037 - DNA, 1548 bp, Neisseria gonorrhoeae
atgatttccggcaaaatcgagattcttgccaaagaaatcgaagtgttgaacgccgccgctacgccgccgttccaaatcgacgacgaaaacatcagcgaaaacgtgcgcctgaccaaccgcgttatcgacctgcgccgccctgtgatgcagcgcaacctgcgcctgcgttaccaagtcgctacgggcgttcgccgttatctggacgcgcaaggcttcatcgacatcgaaacgccgatgctgacccgctccactccggaaggcgcgcgcgactacctcgtaccgagccgcgttcatccgggcgagtttttcgcgctgccgcaatcgccgcaattattcaaacaactgttgatggtggcgggtttcgaccgttactaccaaatcaccaagtgcttccgtgacgaagacttgcgcgccgaccgccaacctgaattcactcaaatcgacttggaaacctcgttcctgaacgaggatgaaatcatggacatcactgaaggcatggccaaacaagtcttcaaagatgctttgaacgtagatttgggcgacttcccacgcatgccttattctgaagccatgttctactacggctctgacaaaccggacatgcgcatcaacttaaaattcaccgagttgaccgacctgatgaaaacggaagaattcaaagtcttccgtggcgcagccgacatgaaaggcggccgcgtagtcgctctgcgcgtgcctaacggcgccaaattcagccgcaaagaaatcgacgaatacactaaatttgtcggcatctacggcgcgaaaggtctggcatacatcaaagtaaacgatgcgggcaacctctccaacggcgaagacagcggcctgcaatctccaatcgtaaaattcttgtctgaaaacgccctgaaagaaatcatcgagcgtaccgccgcgcaaaacggcgacatcatcttcttcggtgcggacaaagccaaagtcgtgaacgaagccgtcggcgcattgcgtatcaaagtcggcttggaacacggcaaagacaacggctacttcacagacgaatggaaacctttgtgggttgtcgatttcccgatgttcgaatacgacgaagaagccgaccgctacgttgccgtacaccatccgtttaccgctcctaaagaaggtcatgaagacctgatggtttccgatcctgcaaactgcctggcccgtgcctacgatatggtattgaacggctgggaaatcggcggaggctctatccgtatccaccgtgcagacgtacaagggaaagtgtttgccgcgctgaaaatcagccctgaagagcaacaagagaaattcggcttcctcttggacaacctgaaattcggtgcgcctcctcacggcggccttgcattcggcctcgaccgtctggtaacgctgatgaccggtgccgaatccatccgcgacgtgattgccttcccgaaaacacaacgcgcccaatgcctgctgaccgatgcgcccaacagcgtggacgataagcagttgcgtgaattgagcctgcgtctgcgtcaaaaagcagttgaaacaaaagaagca

SEQ ID NO: 7038 - protein, 516 aa, Neisseria gonorrhoeae
MISGKIEILAKEIEVLNAAATPPFQIDDENISENVRLTNRVIDLRRPVMQRNLRLRYQVATGVRRYLDAQGFIDIETPMLTRSTPEGARDYLVPSRVHPGEFFALPQSPQLFKQLLMVAGFDRYYQITKCFRDEDLRADRQPEFTQIDLETSFLNEDEIMDITEGMAKQVFKDALNVDLGDFPRMPYSEAMFYYGSDKPDMRINLKFTELTDLMKTEEFKVFRGAADMKGGRVVALRVPNGAKFSRKEIDEYTKFVGIYGAKGLAYIKVNDAGNLSNGEDSGLQSPIVKFLSENALKEIIERTAAQNGDIIFFGADKAKVVNEAVGALRIKVGLEHGKDNGYFTDEWKPLWVVDFPMFEYDEEADRYVAVHHPFTAPKEGHEDLMVSDPANCLARAYDMVLNGWEIGGGSIRIHRADVQGKVFAALKISPEEQQEKFGFLLDNLKFGAPPHGGLAFGLDRLVTLMTGAESIRDVIAFPKTQRAQCLLTDAPNSVDDKQLRELSLRLRQKAVETKEA

SEQ ID NO: 7039 - DNA, 255 bp, Neisseria gonorrhoeae
atgggtttcgggatgttcttcgtcaatcaggatgcagtccaccgggcaaacctgctggcactgcggctcatcgtagtgtccgacgcactgcgtgcagaggttggggttgatttcgtaaatttcctcgccttgggaaatggcatcattggggcattcgggttcgcatacgtcgcagttgatgcactcgtcggtaataaaaagcgacatttcttttccttttccactaaattatcaaaaccgggcgggcgcggatta

SEQ ID NO: 7040 - protein, 85 aa, Neisseria gonorrhoeae
MGFGMFFVNQDAVHRANLLALRLIVVSDALRAEVGVDFVNFLALGNGIIGAFGFAYVAVDALVGNKKRHFFSFSTKLSKPGGRGL

SEQ ID NO: 7041 - DNA, 1041 bp, Neisseria gonorrhoeae
atggcggcatttccatctgaagcagaaagccctgtcatgtatccacttgcccgccgcatcctgtttgcactcgatgccgaaaaagcccaccacttcacgctcgacgcgctcaacacggtttataaattgggcctgattcccgtaaccgacaaccgtaccaaacctataaaactgatgggtatggatttgcccaaccctgtcgggcttgccgcaggtctcgacaaaaacggtgaatacatcgacgctttgggcgcgctcggtttcggcttcctcgaaatcggcacggttacgcgcaacccgcagcccggcaacccgcagccgcgcctcttccgcgttcccgaacaccaaggcatcatcaaccgaatgggttttaacaaccacggcatcgacgcgatgatacgcaatattgaaaaaagcaaatatcaaggcgtattgggcatcaacatcggcaaaaacgcggttacgcccatccaaaacgccgccgatgattatttaatctgcctcgaaaaagcctacgcgcacgcaagctacattaccgtcaacatttcctcgcccaacaccaaaaacctccgcgcgctgcaaggcggcggcgaattgggcgcattgctcgaagccctgaaaaacaaacaggcgcagcttgccgccgcccacggcaaatatatcccgctagccgtcaaaatcgcccccgatttggatgaagcacaaatcgaagacatcgcccgcgtcgtcaaatccgtcgaaatggacggcatcatcgctaccaacaccaccatcgacaaatcaagcctcggcagccatccgctcgcaggcgagcagggcggtttgagcggttttcccgtgcgcgaaaaaagcaaccgggtgctgaaaaaactggcggaacacatagacggcgcattgccgattatcggcgtaggcggcattatggaaggcggggacgcggcagagaaaatccgcttgggcacgaccgccgtccaagtgtacagcggattgatatacaaaggcccggcgttggtcaaagaatgtttgaaggcattggcgcga

SEQ ID NO: 7042 - protein, 347 aa, Neisseria gonorrhoeae
MAAFPSEAESPVMYPLARRILFALDAEKAHHFTLDALNTVYKLGLIPVTDNRTKPIKLMGMDLPNPVGLAAGLDKNGEYIDALGALGFGFLEIGTVTRNPQPGNPQPRLFRVPEHQGIINRMGFNNHGIDAMIRNIEKSKYQGVLGINIGKNAVTPIQNAADDYLICLEKAYAHASYITVNISSPNTKNLRALQGGGELGALLEALKNKQAQLAAAHGKYIPLAVKIAPDLDEAQIEDIARVVKSVEMDGIIATNTTIDKSSLGSHPLAGEQGGLSGFPVREKSNRVLKKLAEHIDGALPIIGVGGIMEGGDAAEKIRLGTTAVQVYSGLIYKGPALVKECLKALAR

SEQ ID NO: 7043 - DNA, 234 bp, Neisseria gonorrhoeae; identical to SEQ ID NO: 3995

SEQ ID NO: 7044 - protein, 78 aa, Neisseria gonorrhoeae; identical to SEQ ID NO: 3996

SEQ ID NO: 7045 - DNA, 252 bp, Neisseria gonorrhoeae
atgcgtaccaactattgcggcctgatcagcgagcaatacttatgccaaaccgttaccgtcaaaggctgggtacaccgccggcgcgaccacggcggtgtgatttttatcgacctgcgcgaccgcgaaggcatcgtccaagtcgtgatcgatcccgacacgcccgaagcgtttgccgctgccgattccgcccgtaacgaatacgttttgggcattgccggccgcgtacgcaaccgtccgaagcacgaccaacga

SEQ ID NO: 7046 - protein, 84 aa, Neisseria gonorrhoeae
MRTNYCGLISEQYLCQTVTVKGWVHRRRDHGGVIFIDLRDREGIVQVVIDPDTPEAFAAADSARNEYVLGIAGRVRNRPKHDQR

SEQ ID NO: 7047 - DNA, 273 bp, Neisseria gonorrhoeae
ttgcgcggtgcagcagaggctgttgtgtcgggcgacgaccggttagccgttgtgggcattgatgtagtcgatagccagttggacggtggtgattttttcggcatcttcgtcggggatttcgcagccgaaggcttcttccaaagccataaccaactccacggtatccaaagaatccgcgcccaagtcgtcttggaaggaagattcgtttttcacgtcggcttcgtttacgcccagttgttcagcaataattttcttaacttgttgttcgatgtt

SEQ ID NO: 7048 - protein, 91 aa, Neisseria gonorrhoeae
LRGAAEAVVSGDDRLAVVGIDVVDSQLDGGDFFGIFVGDFAAEGFFQSHNQLHGIQRIRAQVVLEGRFVFHVGFVYAQLFSNNFLNLLFDV

SEQ ID NO: 7049 - DNA, 1341 bp, Neisseria gonorrhoeae; identical to SEQ ID NO: 4033

SEQ ID NO: 7050 - protein, 447 aa, Neisseria gonorrhoeae; identical to SEQ ID NO: 4034

SEQ ID NO: 7051 - DNA, 567 bp, Neisseria gonorrhoeae
ttcagccacttggaaaacccttaattcaaatgtaccctgccccgacttcccctccctatatcccgtcagccaatcaggtttgtccggctgcctgcctgcctcgatataaacatatgcgccgtcattcaggcgtgtgcccaatacattgaaaagactttcccaactttgccacgcaaacggcggatcaaggaagacgacatcgaatttctcttttaggtttgccaaataggcaatgccgtccgaacagacggtttgcacctgccccaaacccagttcgcggctgtttttctcaagggtttgcaccgtttgacggttgttgtctgcaatcacgacccgttttgcattacgcgatgccgcctccatgccgagtgcgccgctgcctccgaagagatccaaaaccgtttttcccgtcaaatcttgtcccagccagttaaacagcttttcacgcacgctgtcgggggttgggcgcagtccgtcggcggatgcaaaactcaatttcctgccccggcattgcccgccgataatgcgtacccggttgctgtgtttggtatgtttgcctgccgccat

SEQ ID NO: 7052 - protein, 7 aa, Neisseria gonorrhoeae
FSHLENP

SEQ ID NO: 7053 - DNA, 699 bp, Neisseria gonorrhoeae
atgacggaacctgcggccgaaggcggcaaagctgccaaggcgttaaaaaaatatctgattacaggcattttggtctggctgccgattgcggtaacggtttgggtggtttcctatatcgtttccgcgtccgaccagcttgtcaacctgctgccgaagcaatggcggccgcaatatgttttggggtttaatatccccgggctcggcgttattgttgccattgccgtattgtttgtaaccggattatttgccgcaaacgtgttgggccggcagattcttgccgcgtgggacagcctgttggggcggattccggttgtcaaatccatctattcgagtgtgaaaaaagtatccgaatcgctgctgtccgacagcagccgttcgtttaaaacgccggtactcgtgccgtttccccaatcgggtatttggacaatcgcattcgtgtccggtcaggtgtcgaatgcggttaaggccgcattgccgcaggatggcgattatctttccgtgtatgtcccgaccacgcccaacccgaccggcggttactatattatggtaaagaaaagcgatgtgcgcgaactcgatatgagcgtggacgaagcgttgaaatatgtgatttcgctgggtatggtcatccctgacgacctgcccgtcaaaacattggcaggacctatgccgcctgaaaaggcggagttgcccgaacaacaa

SEQ ID NO: 7054 - protein, 233 aa, Neisseria gonorrhoeae
MTEPAAEGGKAAKALKKYLITGILVWLPIAVTVWVVSYIVSASDQLVNLLPKQWRPQYVLGFNIPGLGVIVAIAVLFVTGLFAANVLGRQILAAWDSLLGRIPVVKSIYSSVKKVSESLLSDSSRSFKTPVLVPFPQSGIWTIAFVSGQVSNAVKAALPQDGDYLSVYVPTTPNPTGGYYIMVKKSDVRELDMSVDEALKYVISLGMVIPDDLPVKTLAGPMPPEKAELPEQQ

SEQ ID NO: 7055 - DNA, 147 bp, Neisseria gonorrhoeae
ttgccgccttcggccgcaggttccgtcatcttgcttgattccgacaaagtccgtacaaaccgcacattatacgcgtttgcccggattcaaacgaattttttatcccgccccgccaaaccgccggcggcttcagacggcacggcaact

SEQ ID NO: 7056 - protein, 49 aa, Neisseria gonorrhoeae
LPPSAAGSVILLDSDKVRTNRTLYAFARIQTNFLSRPAKPPAASDGTAT

SEQ ID NO: 7057 - DNA, 225 bp, Neisseria gonorrhoeae
ttggtatgtttgcctgccgccataatcaaaagcctgaaagttcaaacggtattatacaagacctgtcgaagaatatgccgcctgaaaacttttttcagacggcatatctgtttaaacggtttcggtcagcttgcggagcaactcgatttctttgtcttttgttccaacatttctttgcagtgtttcaattccatttttaacaaatccagctttaccgatgcatcc

SEQ ID NO: 7058 - protein, 75 aa, Neisseria gonorrhoeae
LVCLPAAIIKSLKVQTVLYKTCRRICRLKTFFRRHICLNGFGQLAEQLDFFVFCSNISLQCFNSIFNKSSFTDAS

SEQ ID NO: 7059 - DNA, 108 bp, Neisseria gonorrhoeae
ttgaaaaataacggattggacaccgcatcgacagaaaaacccgccgcgcacttgtcaaaaccctgtttgcaggcgtatctttacaaccttcaaattcaaaccgttcat

SEQ ID NO: 7060 - protein, 36 aa, Neisseria gonorrhoeae
LKNNGLDTASTEKPAAHLSKPCLQAYLYNLQIQTVH

SEQ ID NO: 7061 - DNA, 486 bp, Neisseria gonorrhoeae
atgaccccgttatttagaaaagccgtttggctgctgtttgccgtttcggtctgtgcatttgccggttctttggcggcacagtatgttttgggtatggagccttgcgttttgtgcatcagtcagcggttatgtgttttggcaaccgcattgtgtgcggcagttgtgctggcgtgtaagcccaagggcagggtgggcggactgtcaggcgcagtgtttatcagtattcccgccgttacgggtatttctgttgcggcatatcagttgtggttgcagtcgctgccgccgggtgcggctccttcgtgcggcgcgccgtggacgtttcgattgaagggctggcctttgtttgattggttcgagcctgttgtgcgcgggttcggaaattgtgccgaaccggattatctgttaggggttgctttgcctgtttggagcgcggcgtattttttggcggttgtcctgacggtttggtgggcgtgggcaagggctaaa

SEQ ID NO: 7062 - protein, 162 aa, Neisseria gonorrhoeae
MTPLFRKAVWLLFAVSVCAFAGSLAAQYVLGMEPCVLCISQRLCVLATALCAAVVLACKPKGRVGGLSGAVFISIPAVTGISVAAYQLWLQSLPPGAAPSCGAPWTFRLKGWPLFDWFEPVVRGFGNCAEPDYLLGVALPVWSAAYFLAVVLTVWWAWARAK

SEQ ID NO: 7063 - DNA, 132 bp, Neisseria gonorrhoeae
ttgaaaaaagaatccatatcggtgtttccgcgcaggaggcatcgtgccgccgtgcgatgttatgctgtatcagtcgaaaatatcttgttgattgtatataaaaaaacggctgtttggcaaaaaacggcttgt

SEQ ID NO: 7064 - protein, 44 aa, Neisseria gonorrhoeae
LKKESISVFPRRRHRAAVRCYAVSVENILLIVYKKTAVWQKTAC

SEQ ID NO: 7065 - DNA, 1209 bp, Neisseria gonorrhoeae
ttgatatgccgtttgaaacggtattcagatgccgtcccagtcgttgaacatcaacccgataccgataccgttctgcttgtggttgtagtcgatcaggctctcgccgtaaccgtggaatccgcgtaccacgcctttgagtttgcccttaatcggaaacgtgtaggcggcttcaatcgcgccgtagcccgttttggggttgtagcgcaatacggaatacacattctgcctgtcgttcaggcggtactgcagcttcacgtcgccataccccatatagtcggcaatatcgggattgtcgtttttatcgccgctctgatcgaacgcacgcacccacacgcgcggaatcaccgtcaatttgccccattccatgcctgccatggcataaatcctgttccacgaacgcgattcgggacggctctgtccgttggactggtggacaaaacccgcaccgagcatacgcagcctgccgccgaacggcaaatccgccttcacaggctgggtcaggaaaatttcaggtttgtaatccgtattgcggaacggcgcggatttcctgccttggttgtaaatctgccaatcggatctttgggtgtagccgaaccacagatccgcgcgggttttaaacaaattttcggcaattttgcttttgaacgaaacctgcaatttggtttccgcacgtttctgctgtccgaatttttcctgtacagtcgtaccgcgcgtcggcgaactcggggcatagttgggcgaattgttataccaaaacggcataaggtacatcggattgtgttcgcgtacgcccaacagcccgcgcaaatcgtttttgtccaagtcgtacatcaggctcaaaggcgtatagatatcggcggtttcgcccgcactgtcggcaggaagcgcatccccgcctttttcaacaacaatgaccgcctcgcccttatccaagctgctgcggacggtttccgtcagattgagtacggctttcgactcctgcccttcctgccctgccgaagacggaagctgtgccgcaaaaatcctgtcgtaacacgccaaacgcgtaacattgtccgtcaaagcggcgcattgcagcgcggtctctccaaaagcggatgccgtcggcaacagtcctgtcaaaagaatatagcgcatatttcgtgtattcatctccgcccccattgtcggcatattggttttcaaacggcattttatagcggattcgga

SEQ ID NO: 7066 - protein, 403 aa, Neisseria gonorrhoeae
LICRLKRYSDAVPVVEHQPDTDTVLLVVVVDQALAVTVESAYHAFEFALNRKRVGGFNRAVARFGVVAQYGIHILPVVQAVLQLHVAIPHIVGNIGIVVFIAALIERTHPHARNHRQFAPFHACHGINPVPRTRFGTALSVGLVDKTRTEHTQPAAERQIRLHRLGQENFRFVIRIAERRGFPALVVNLPIGSLGVAEPQIRAGFKQIFGNFAFERNLQFGFRTFLLSEFFLYSRTARRRTRGIVGRIVIPKRHKVHRIVFAYAQQPAQIVFVQVVHQAQRRIDIGGFARTVGRKRIPAFFNNNDRLALIQAAADGFRQIEYGFRLLPFLPCRRRKLCRKNPVVTRQTRNIVRQSGALQRGLSKSGCRRQQSCQKNIAHISCIHLRPHCRHIGFQTAFYSGFG

SEQ ID NO: 7067 - DNA, 555 bp, Neisseria gonorrhoeae; identical to SEQ ID NO: 143

SEQ ID NO: 7068 - protein, 185 aa, Neisseria gonorrhoeae; identical to SEQ ID NO: 144

SEQ ID NO: 7069 - DNA, 336 bp, Neisseria gonorrhoeae
gcttgcggagcaactcgatttctttgtcttttgttccaacatttctttgcagtgtttcaattccatttttaacaaatccagctttaccgatgcatcctgagcggtatagattgcaaattccccgctgttggtatccacatcgttaatctgcaacaccatccctccgccacccgatttgagcgaatcccgacaaatccggattcccgcctgcgcgggaatggcgggttttagggttacggtgtatcggcaatggcggtacgggtatttccccgcacctgccccgcgcccgtaaacggcgagcgcgtcaaaaatgccgtctgaaggttcagacggcat

SEQ ID NO: 7070 - protein, 23 aa, Neisseria gonorrhoeae
ACGATRFLCLLFQHFFAVFQFHF

SEQ ID NO: 7071 - DNA, 675 bp, Neisseria gonorrhoeae; identical to SEQ ID NO: 145

SEQ ID NO: 7072 - protein, 225 aa, Neisseria gonorrhoeae; identical to SEQ ID NO: 146

SEQ ID NO: 7073 - DNA, 843 bp, Neisseria gonorrhoeae
gaagcggtagcgcacgcccaatgaggcttcgtgggttttgaagcgggtgttttccaggcgtccccaatagtggtagcggtagccggcgtccaaggtcaggccgggcgcgacgtctatgcccacgcccgccatcgcgccgaagcccaagcggcggctgctgcggttttcgtgataggcaggtttggggggcatttctgatggaacagaagttttcgcactaccgtcgcttgggtaagtggtaacagtcgtggtttctttttccattgaatgaacctgatgtctgacgtgtccgtaggcgacgcgcacgccgatatagggtttgaatttatcgttggctctgaaatcgtaaacggttgacaagccgagagaagaaacggcgtggaatgtgccgttttcttgatgttccgtcttttgggtttttatgttaagatgcttgctgtcagaagcgctattatcgtttcttcccaactcttttatgttcacggaatatttattgttgtgccatttcctgtaacgggcataatccgcggcgatgcgccagccgccgaaatcgtagccgaaggcaagccgggggtggacggagcgggtgcggatgtttttgaaataatcgcttaccgtgcttatttttttgccttggtttgcaccggctgcatcgggataatcgcgggtgatgtgctcgtaggcgtaagccagatccgcctgcacatacgggccgcgcccatggtcttcacccgccgcccgcgctgcggaagagaagagaagagaagagaagagaagagaagagaagagaagagaagagaagagaagagaagagaagttttttgtcggccgtatgcatatcaa

SEQ ID NO: 7074 - protein, 7 aa, Neisseria gonorrhoeae
EAVAHAQ

SEQ ID NO: 7075 - DNA, 1158 bp, Neisseria gonorrhoeae
ttgaaaaccaatatgccgacaatgggggcggagatgaatacacgaaatatgcgctatattcttttgacaggactgttgccgacggcatccgcttttggagagaccgcgctgcaatgcgccgctttgacggacaatgttacgcgtttggcgtgttacgacaggatttttgcggcacagcttccgtcttcggcagggcaggaagggcaggagtcgaaagccgtactcaatctgacggaaaccgtccgcagcagcttggataagggcgaggcggtcattgttgttgaaaaaggcggggatgcgcttcctgccgacagtgcgggcgaaaccgccgatatctatacgcctttgagcctgatgtacgacttggacaaaaacgatttgcgcgggctgttgggcgtacgcgaacacaatccgatgtaccttatgccgttttggtataacaattcgcccaactatgccccgagttcgccgacgcgcggtacgactgtacaggaaaaattcggacagcagaaacgtgcggaaaccaaattgcaggtttcgttcaaaagcaaaattgccgaaaatttgtttaaaacccgcgcggatctgtggttcggctacacccaaagatccgattggcagatttacaaccaaggcaggaaatccgcgccgttccgcaatacggattacaaacctgaaattttcctgacccagcctgtgaaggcggatttgccgttcggcggcaggctgcgtatgctcggtgcgggttttgtccaccagtccaacggacagagccgtcccgaatcgcgttcgtggaacaggatttatgccatggcaggcatggaatggggcaaattgacggtgattccgcgcgtgtgggtgcgtgcgttcgatcagagcggcgataaaaacgacaatcccgatattgccgactatatggggtatggcgacgtgaagctgcagtaccgcctgaacgacaggcagaatgtgtattccgtattgcgctacaaccccaaaacgggctacggcgcgattgaagccgcctacacgtttccgattaagggcaaactcaaaggcgtggtacgcggattccacggttacggcgagagcctgatcgactacaaccacaagcagaacggtatcggtatcgggttgatgttcaacgactgggacggcatc

SEQ ID NO: 7076 - protein, 386 aa, Neisseria gonorrhoeae
LKTNMPTMGAEMNTRNMRYILLTGLLPTASAFGETALQCAALTDNVTRLACYDRIFAAQLPSSAGQEGQESKAVLNLTETVRSSLDKGEAVIVVEKGGDALPADSAGETADIYTPLSLMYDLDKNDLRGLLGVREHNPMYLMPFWYNNSPNYAPSSPTRGTTVQEKFGQQKRAETKLQVSFKSKIAENLFKTRADLWFGYTQRSDWQIYNQGRKSAPFRNTDYKPEIFLTQPVKADLPFGGRLRMLGAGFVHQSNGQSRPESRSWNRIYAMAGMEWGKLTVIPRVWVRAFDQSGDKNDNPDIADYMGYGDVKLQYRLNDRQNVYSVLRYNPKTGYGAIEAAYTFPIKGKLKGVVRGFHGYGESLIDYNHKQNGIGIGLMFNDWDGI

SEQ ID NO: 7077 - DNA, 828 bp, Neisseria gonorrhoeae; identical to SEQ ID NO: 4171

SEQ ID NO: 7078 - protein, 276 aa, Neisseria gonorrhoeae; identical to SEQ ID NO: 4172

SEQ ID NO: 7079 - DNA, 318 bp, Neisseria gonorrhoeae; identical to SEQ ID NO: 147

SEQ ID NO: 7080 - protein, 106 aa, Neisseria gonorrhoeae; identical to SEQ ID NO: 148

SEQ ID NO: 7081 - DNA, 294 bp, Neisseria gonorrhoeae
ttggcggttttgcaaaaatcaagccagtgcttttacttttgcagacaggcggcttttgtggcgagccgctttgtttttatgaaacacgcctttgtcggcgatgcggtcgatgactttgacggactcttggtaaaccgcttgtgcggcagctttatcgcctgcttcgactgctttcaatacttttttcactgcggtgcggaatgcggtacgcaggctagcgttgtgggcgcgttgtttgacggactggcgggcacgtttgcgtgcttgtgcgctgtttgccatattggaatctcc

SEQ ID NO: 7082 - protein, 98 aa, Neisseria gonorrhoeae
LAVLQKSSQCFYFCRQAAFVASRFVFMKHAFVGDAVDDFDGLLVNRLCGSFIACFDCFQYFFHCGAECGTQASVVGALFDGLAGTFACLCAVCHIGIS

SEQ ID NO: 7083 - DNA, 168 bp, Neisseria gonorrhoeae
aagaatgtatttattttttaaaatcccggccagccgggataaatcctgctttaccaattgttttaaaatggaaattcgaacttttaccccactgttgtcaaaacgccgtccgcactccttcaaatacagcccgaaatgctctttgggaatgccgtcaaacttgcgcaa

SEQ ID NO: 7084 - protein, 6 aa, Neisseria gonorrhoeae
KNVFIF

SEQ ID NO: 7085 - DNA, 456 bp, Neisseria gonorrhoeae
gtgatgattttacacccgaagggaaaacgggcttatttgaatggcggtttaatcgcggcggttatttgcggtttgataaggctgatttgcgtgccgtgcagtccggcaacgggcggggtgtttggaaaatgccgtctgaaggtttcagacggcattctgtcatgcggcggttcggggttcgcggacgggcaggacaagcagggctgccgtgccggcgagtacggcatcggcgtaccacatccagccgtagtcaccgaattgtgtaatcacgatgccgccgatgtacgagccgaggaatccgccgatttggtgggtgagcatcaccagtccgaacagggtggcgaggtagcgcgtgccgaagagtttgccggtaacggcggcggtcggggcgacggtggcgagccatgtgaatccgagtgcggcggcgaaaatgtaaaagttgaggtcggttttggg

SEQ ID NO: 7086 - protein, 152 aa, Neisseria gonorrhoeae
VMILHPKGKRAYLNGGLIAAVICGLIRLICVPCSPATGGVFGKCRLKVSDGILSCGGSGFADGQDKQGCRAGEYGIGVPHPAVVTELCNHDAADVRAEESADLVGEHHQSEQGGEVARAEEFAGNGGGRGDGGEPCESECGGENVKVEVGFG

SEQ ID NO: 7087 - DNA, 1227 bp, Neisseria gonorrhoeae; identical to SEQ ID NO: 4219

SEQ ID NO: 7088 - protein, 409 aa, Neisseria gonorrhoeae; identical to SEQ ID NO: 4220

SEQ ID NO: 7089 - DNA, 552 bp, Neisseria gonorrhoeae
aatacagcccgaaatgctctttgggaatgccgtcaaacttgcgcaaatgacgtttgcccgattccaaaagttcccaattgcgttgatatggttttgccgttcggcaaaatgtgtgccgcgattgatacggaaacggccaaatccgcttacaatctgatacatcgtaactacgaacaatccgtataaacaatgctgccgggtttcacccgtccgcggataataggcaataaaatagcggttcgagtgtccgacagtaaccgtacaaaccttgccgttgcgcttcaaaagcccgaatacggcggctttgccggcggcactgcggccgcgtctgcctttacggaaataactttcacccgcccctgcttcgccgtcatacatttccaaatgcggactgttttgacggataagtaatcgtaaacgatatgtcgtatgcctccataatttcgcagatttcgtccaaatgcgtgtaaaggaagttttcccgatgatgtgccaaacactatttcgccatagaaaataacaggctgccgtgttttgattaactgctgccaa

SEQ ID NO: 7090 - protein, 61 aa, Neisseria gonorrhoeae
NTARNALWECRQTCANDVCPIPKVPNCVDMVLPFGKMCAAIDTETAKSAYNLIHRNYEQSV

SEQ ID NO: 7091 - DNA, 261 bp, Neisseria gonorrhoeae
atggcaaacagcgcacaagcacgcaaacgtgcccgccagtccgtcaaacaacgcgcccacaacgctagcctgcgtaccgcattccgcaccgcagtgaaaaaagtattgaaagcagtcgaagcaggcgataaagctgccgcacaagcggtttaccaagagtccgtcaaagtcatcgaccgcatcgccgacaaaggcgtgtttcataaaaacaaagcggctcgccacaaaagccgcctgtctgcaaaagtaaaagcactggct

SEQ ID NO: 7092 - protein, 87 aa, Neisseria gonorrhoeae
MANSAQARKRARQSVKQRAHNASLRTAFRTAVKKVLKAVEAGDKAAAQAVYQESVKVIDRIADKGVFHKNKAARHKSRLSAKVKALA

SEQ ID NO: 7093 - DNA, 1350 bp, Neisseria gonorrhoeae
ttgcggtgcaggcggttcgatttgttctttccagccgcattctttttgcgggcagactttttccacgccccggcgtttggtagttttgatggccagtaccggccaatggcagttcgggcattcttcggcaacgggcgggttccaagtggcgtagttgcagtcgggataggtgctgcaactgtaaaacagtttgccgtagcgggatttgcgctcgacgaggttgccttttttgcattgcgggcattggacgccggtatctttgggtttttccaacggctcgacgtgtttgcatttggggtagttggcgcaaccgatgaatttactgccggtgcggctgtatttgtacaccagccgtccgccgcatttggggcattcgcgaccgtcgagttcgacctgttcggcttccgctttggcgatgcgttcggcagcttcttcggcggtttcgttgacgttgcgggtgtaactgcactcgggataaccggcacacgcaacgaaacggcccattttgccgaacttgatttgcagtttgtgttcgccgcatttcgggcaggtttcgtcaagttcctgcgtagtgaatttggcgcgttcgatgccctctttttcttccacttgtttgatgaacggtttccagaatttgtccatcacgggaatccagcggcgtttgccgtcggcgatttcgtcaagctggtcttcgagtttggcggtgaagtggtaatcgacgtattgggcgaagtgttcggtcaggaatttattgacgatgtcgcctgtgtcggtgggcatgaagcgtttttgctcaagggtaacgtattcgcggtctttgagcgtagaaataatgctggcgtaggtcgaggggcggccgatgccgtattcttcgagggctttaaccagtgtggcttcgttgtagcgcggcggcggggtggtgaagtgttgttcgccgtagagtttgtcgaccggcaatttgtcgccttcgctcatttcgggcagttttttgctgtcttcgctctcttcatcgtcgctgctttcttcgtaaacgctgaggaagcctgcgaaggtttgcacttgtccggttactcggaacacgcctttgccgacggtaatatcgacggtggtttggtcgaatttggcgggcgtcatctgacaggcaacggtacgctgccaaatcatttgatagagtttgaactggtctgcactcaggaagggtttgacgctttcgggcgtgcggtacacggaagtcgggcggatcgcttcatgggcttcttgggcgtttttggatttggttttgtattgtttggcggcactcggcagatattctttgccgattttgttttcaatgtaatggcggatttcggt

SEQ ID NO: 7094 - protein, 450 aa, Neisseria gonorrhoeae
LRCRRFDLFFPAAFFLRADFFHAPAFGSFDGQYRPMAVRAFFGNGRVPSGVVAVGIGAATVKQFAVAGFALDEVAFFALRALDAGIFGFFQRLDVFAFGVVGATDEFTAGAAVFVHQPSAAFGAFATVEFDLFGFRFGDAFGSFFGGFVDVAGVTALGITGTRNETAHFAELDLQFVFAAFRAGFVKFLRSEFGAFDALFFFHLFDERFPEFVHHGNPAAFAVGDFVKLVFEFGGEVVIDVLGEVFGQEFIDDVACVGGHEAFLLKGNVFAVFERRNNAGVGRGAADAVFFEGFNQCGFVVARRRGGEVLFAVEFVDRQFVAFAHFGQFFAVFALFIVAAFFVNAEEACEGLHLSGYSEHAFADGNIDGGLVEFGGRHLTGNGTLPNHLIEFELVCTQEGFDAFGRAVHGSRADRFMGFLGVFGFGFVLFGGTRQIFFADFVFNVMADFG

SEQ ID NO: 7095 - DNA, 1200 bp, Neisseria gonorrhoeae
gtgtttatggggcgcggggttttctttttttccaacctctttcatcaggaatctgcccgtatgaaaaaatccgtattagccgttttggccgcgctgtctctggcagcctgcggcggcagcgaaaaaaacgccgtgcagcctcaagcaggcagcgcacctgctgccaatgccgaagccgctgccaccgatactctgaacatctacaactggtcgaattatgttgacgagagtacggtcgaagactttaaaaaagccaacaatctgaagctgacttacgacttgtacgaaaacaacgaaacgctggaagccaaaatgctgaccggcaaatccggttacgatttggttgtgccgggcatcgccttcctgccgcgccaaatcgaggcgggcgcgtatcaaaaagtcaacaaagacctgattcccaactataaaaacatcgatcccgaactcttgaaaatgctggaagccgccgacccgggcaaccagtatgccgtcccctatttctccggcgtgaacacggttgcgattacggcgaagggcaaagagcttttgggcggcaagctgcccgaaaacggctgggatttgctgttcaaacccgaatacacccgcaagctgaaatcctgcggcatcgccttgtgggacacccccagcgaaatgttcccgattttgctgaactacttgggcaaagaccccaaaggttcgaatcctgaagatttgaaggcggcggcggaagtgttgaagtctatccgtccggacgtcaaacgtttcagcccgtccatcatcgacgagctggcgcgcggcgacatctgcctggcggcaggcaacggcggcgatttgaacttggcgaaagcgcgttccgaagaagtgaaaaacaacgtcggcatcgaagtgctgacaccgaaaggtatgggcttctggattgagtcttggctgattcccgccgatgcgaaaaacgtcgccaacgcccacaaatacatcaactacacgctcgaccccgaaatcgcggcgaaaaacggcatcgccgtaaccttcgcccccgccagcaaaccggcgcgcgaaaaaatgcctgccgagttggtgaacacccgttccatcttcccgaacgagcaggatatgaaagacggtttcgtcatgccgcaaatgagcgcggatgcgaaaaaactgtcggtcagcctgtggcagaaaatcaaagtcggcaccaac

SEQ ID NO: 7096 - protein, 400 aa, Neisseria gonorrhoeae
VFMGRGVFFFSNLFHQESARMKKSVLAVLAALSLAACGGSEKNAVQPQAGSAPAANAEAAATDTLNIYNWSNYVDESTVEDFKKANNLKLTYDLYENNETLEAKMLTGKSGYDLVVPGIAFLPRQIEAGAYQKVNKDLIPNYKNIDPELLKMLEAADPGNQYAVPYFSGVNTVAITAKGKELLGGKLPENGWDLLFKPEYTRKLKSCGIALWDTPSEMFPILLNYLGKDPKGSNPEDLKAAAEVLKSIRPDVKRFSPSIIDELARGDICLAAGNGGDLNLAKARSEEVKNNVGIEVLTPKGMGFWIESWLIPADAKNVANAHKYINYTLDPEIAAKNGIAVTFAPASKPAREKMPAELVNTRSIFPNEQDMKDGFVMPQMSADAKKLSVSLWQKIKVGTN

SEQ ID NO: 7097 - DNA, 105 bp, Neisseria gonorrhoeae
ttggacggggattcgacgattaagaggtttttcgccatttgtcgttctctggatggtggttttgacgccggtgtttcagacggcatcgggcgggccggcgccgtc

SEQ ID NO: 7098 - protein, 35 aa, Neisseria gonorrhoeae
LDGDSTIKRFFAICRSLDGGFDAGVSDGIGRAGAV

SEQ ID NO: 7099 - DNA, 810 bp, Neisseria gonorrhoeae
ttgcgccgacaggctgaaaataacaatttttaccgcattatcattaccttaatcggaataaagctcaaacagacccagcagctcgaccagcggctgcaacaatctttgcgcgtattgcagatgccgggtatcgaacttgaacgcgaggtcgaaaactggccgtcggacaaccccctgctcgaacgcaaagaaacggatgaattttccgatgccgaattcagccattacaccgcgcccgcgcgtcaaatcggcggagacgaaggcgaagatatgctgtccaacatcgccggcgaagaagatttcaagcaatacctgcacgcgcaagcgtgcgaacaccccctttccgaccaagaagccgcctgcgtccacatccttatcgatttccttgacgagcagggctacctgaccgacagcatcgaagacatcctggaccatacgcccttggagtggatgttggatgaagcaatgctgaaacaagccctgaccgcattgaaaaaattcgatccggcaggcatggccgccgccgatgtgaccgaatcgttgatattgcagatagaaagatcgggcgaatgtgctgccaaacccgccgccctgcatatcgtccgaaacgccctcgacagcattgacggcaaccgcagccaaaccccggcgcgaataaaaaacgcctgccccaaaccgacagcggcacactcgaagccgcactcggcctcattgcttcgctcaacccctttcccgccgccggttttgcctcgtccacgcccaagtcctattctgacgaggcactcgccaacctgctggctttccgcggta

SEQ ID NO: 7100 - protein, 270 aa, Neisseria gonorrhoeae
LRRQAENNNFYRIIITLIGIKLKQTQQLDQRLQQSLRVLQMPGIELEREVENWPSDNPLLERKETDEFSDAEFSHYTAPARQIGGDEGEDMLSNIAGEEDFKQYLHAQACEHPLSDQEAACVHILIDFLDEQGYLTDSIEDILDHTPLEWMLDEAMLKQALTALKKFDPAGMAAADVTESLILQIERSGECAAKPAALHIVRNALDSIDGNRSQTPARIKNACPKPTAAHSKPHSASLLRSTPFPPPVLPRPRPSPILTRHSPTCWLSAV

SEQ ID NO: 7101 - DNA, 162 bp, Neisseria gonorrhoeae
atgccgtccgaacgatgttcggacggcattttatattggattgaaatagaaatatttataccgtcgcccccacggccgggatttcagattgcggacatttatagcggattaacaaaaaccggtacggcgttgccccgccttagctcaaagagaacgattctc

SEQ ID NO: 7102 - protein, 54 aa, Neisseria gonorrhoeae
MPSERCSDGILYWIEIEIFIPSPPRPGFQIADIYSGLTKTGTALPRLSSKRTIL

SEQ ID NO: 7103 - DNA, 2244 bp, Neisseria gonorrhoeae
ctcttgcggtgcaggcggttcgatttgttctttccagccgcattctttttgcgggcagactttttccacgccccggcgtttggtagttttgatggccagtaccggccaatggcagttcgggcattcttcggcaacgggcgggttccaagtggcgtagttgcagtcgggataggtgctgcaactgtaaaacagtttgccgtagcgggatttgcgctcgacgaggttgccttttttgcattgcgggcattggacgccggtatctttgggtttttccaacggctcgacgtgtttgcatttggggtagttggcgcaaccgatgaatttactgccggtgcggctgtatttgtacaccagccgtccgccgcatttggggcattcgcgaccgtcgagttcgacctgttcggcttccgctttggcgatgcgttcggcagcttcttcggcggtttcgttgacgttgcgggtgtaactgcactcgggataaccggcacacgcaacgaaacggcccattttgccgaacttgatttgcagtttgtgttcgccgcatttcgggcaggtttcgtcaagttcctgcgtagtgaatttggcgcgttcgatgccctctttttcttccacttgtttgatgaacggtttccagaatttgtccatcacgggaatccagcggcgtttgccgtcggcgatttcgtcaagctggtcttcgagtttggcggtgaagtggtaatcgacgtattgggcgaagtgttcggtcaggaatttattgacgatgtcgcctgtgtcggtgggcatgaagcgtttttgctcaagggtaacgtattcgcggtctttgagcgtagaaataatgctggcgtaggtcgaggggcggccgatgccgtattcttcgagggctttaaccagtgtggcttcgttgtagcgcggcggcggggtggtgaagtgttgttcgccgtagagtttgtcgaccggcaatttgtcgccttcgctcatttcgggcagttttttgctgtcttcgctctcttcatcgtcgctgctttcttcgtaaacgctgaggaagcctgcgaaggtttgcacttgtccggttactcggaacacgcctttgccgacggtaatatcgacggtggtttggtcgaatttggcgggcgtcatctgacaggcaacggtacgctgccaaatcatttgatagagtttgaactggtctgcactcaggaagggtttgacgctttcgggcgtgcggtacacggaagtcgggcggatcgcttcatgggcttcttgggcgtttttggatttggttttgtattgtttggcggcactcggcagatattctttgccgattttgttttcaatgtaatggcggatttcggttaacgcttcgtcagccaaattcacgctgtcggtacgcatataggtaatcagaccgatggcaccctgccctacgtctataccttcgtaaagctgctgggcggtacgcatggtgcggtcggtggtgaagcccagtttacgcacggcatcctgctgcatggtggatgtggtaaacggcgcggcggggttgcggctgcgctttttcttttcgatggcggtaacgacggcctctttgccttcgagttctttcaacacatcggcttgagcggcttcgttcggcaggtcgaattgttcgagtttcgcgccgttgtattgggcgagtttggcggtgaacttgctgcggcctttatggctgtcgagatgcaccgtccaatattcctgcgcttcaaacgcgcggatttcgttttcgcgctcgcaaatcagccgcagggcgggactttgcacacggcccgcgctcaaaccgcgtcggatttttttccacagcaacggcgagaggttgaaaccgaccagatagtccaaagcgcggcgggcttgttgcgcatcgaccaaatccatttcgatttcgcgaggatgggcgacggcatcgagcacggcgtttttggtaatctcgtggaacacgacgcgctgcggcttgatgtttttcagaccgcgtttggatttgaggatttccaaaagatgccaagaaatcgcttcgccttccctgtccgggtcggttgcgaggtagatgttttcggcttctttggcagcggcaacaatcgcatcgacatgtttgccgttgcggctgatgagttggtatttcatcgcaaagccgttgtcgggatcgaccgcgccgcttttggggacgaggtcgcggacgtgtccgtaggacgcgaggatttcaaaatcgccgcccaa

SEQ ID NO: 7104 - protein, 451 aa, Neisseria gonorrhoeae
LLRCRRFDLFFPAAFFLRADFFHAPAFGSFDGQYRPMAVRAFFGNGRVPSGVVAVGIGAATVKQFAVAGFALDEVAFFALRALDAGIFGFFQRLDVFAFGVVGATDEFTAGAAVFVHQPSAAFGAFATVEFDLFGFRFGDAFGSFFGGFVDVAGVTALGITGTRNETAHFAELDLQFVFAAFRAGFVKFLRSEFGAFDALFFFHLFDERFPEFVHHGNPAAFAVGDFVKLVFEFGGEVVIDVLGEVFGQEFIDDVACVGGHEAFLLKGNVFAVFERRNNAGVGRGAADAVFFEGFNQCGFVVARRRGGEVLFAVEFVDRQFVAFAHFGQFFAVFALFIVAAFFVNAEEACEGLHLSGYSEHAFADGNIDGGLVEFGGRHLTGNGTLPNHLIEFELVCTQEGFDAFGRAVHGSRADRFMGFLGVFGFGFVLFGGTRQIFFADFVFNVMADFG

SEQ ID NO: 7105 - DNA, 231 bp, Neisseria gonorrhoeae
atggtcagatgggttacggggcatttggaggtagtcatcgctcttgttccttttctcaggttggtcaaatggggggcaaacggcttacagtacgatttggcggaaagcgtattcgtaaccggtttcttgattgtaataaatttcttgaatcgacattttattttccttttgcaaaaactatggatgcgattatacgccaagattttcgttattaaaactatgaaattgatt

SEQ ID NO: 7106 - protein, 77 aa, Neisseria gonorrhoeae
MVRWVTGHLEVVIALVPFLRLVKWGANGLQYDLAESVFVTGFLIVINFLNRHFIFLLQKLWMRLYAKIFVIKTMKLI

SEQ ID NO: 7107 - DNA, 666 bp, Neisseria gonorrhoeae
  MISC_FEATURE (1)..(666): n = g, a, t, or c
atggattcttttttcaaaccggcagtttgggcggttttgtggctgatgtttgccgtccgccccgcccttgccgacgagttgaccaacctgctcagcagccgcgagcagattctcagacagtttgccgaagacgaacagcccgttttacccgtcaaccgagcccccgcccggcgggcgggcaatgccgacgaactcatcggcagcgcgatggggcttaacgaacagcccgttttacccgtcaaccgagcccccgcccggcgggcgggcaatgccgacgaactcatcggcagcgcgatggggcttttgggtattgcctaccgctacggcggcacatcggtttctaccggttttgactgcagcggattcatgcagcacatcttcaaacgcgccatgggcatcaacctgccgcgcacgtcggcggaacaggcgcggatgggcgcacccgttgcccgaagcgaattgcagcccggggatatggtgtttttccgcacgctcggcggcagccgcatttcccatgtcggactttatatcggcaacaaccgcttcatccacgcgccgcgcacggggaaaaatatcgaaatcaccagcctgagccacaaatattggagcggcaaatatgcgttcgcccgccgggtcaagaaaaacgacccgtcacgctntctgaac

SEQ ID NO: 7108 - protein, 222 aa, Neisseria gonorrhoeae
  MISC_FEATURE (1)..(222): Xaa = any amino acid
MDSFFKPAVWAVLWLMFAVRPALADELTNLLSSREQILRQFAEDEQPVLPVNRAPARRAGNADELIGSAMGLNEQPVLPVNRAPARRAGNADELIGSAMGLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRVKKNDPSRXLN

SEQ ID NO: 7109 - DNA, 177 bp, Neisseria gonorrhoeae
atgtattttttcgggcattgtgcggacaaatcgccgttttgtcctttgtcaggttttgtgcatatcgggaaaaccgaaatcgtccgcacctgtgccggtgtcgattcgtcccttgccatctcgggatatatccagcaaaatcggcatatcggtattttgattggtgtgttgagaaaa

SEQ ID NO: 7110 - protein, 59 aa, Neisseria gonorrhoeae
MYFFGHCADKSPFCPLSGFVHIGKTEIVRTCAGVDSSLAISGYIQQNRHIGILIGVLRK

SEQ ID NO: 7111 - DNA, 1476 bp, Neisseria gonorrhoeae; identical to SEQ ID NO: 4325

SEQ ID NO: 7112 - protein, 492 aa, Neisseria gonorrhoeae; identical to SEQ ID NO: 4326

SEQ ID NO: 7113 - DNA, 459 bp, Neisseria gonorrhoeae
gttcatcgtgggtttgttgtcgagtaaaagcgcgctcatcagctcgtcgccgaccaatacgggcagctcgctcttgtttgcccataaaagcagcagggtcagcactttggcggtatctacggtaatttcgtcgccggggatgtgcatgagcgcgtggatgatgatttcccgctgttcgcagctgacggctttttcttcaatcagatactgcatcagccccatcacttcctgcggcaggttgtcggtttcttctttgctgtacacgcgcaatgcgccgctgccggcgggttcggcggaaaattcggagctgttgagcaatacttccatcatcatcagggtgttgccgatttccatcgtatcgaaacccgcttcttcaagcagcatacccaagtcttcgggcggcgggcaggtatcgaaatcttggaaatgttcgatgaggtaggcgatgacttcggtcat

SEQ ID NO: 7114 - protein, 8 aa, Neisseria gonorrhoeae
VHRGFVVE

SEQ ID NO: 7115 - DNA, 144 bp, Neisseria gonorrhoeae
ttgcggattgatttgaagttgcaaaatcccaacgggccggattcccgcctgcgcgggaatgacggcggaaggttttttgtctttcctgattatagtggattaacaaaaatcaggacaaggcgaggaagccgcagacagtacaaa

SEQ ID NO: 7116 - protein, 48 aa, Neisseria gonorrhoeae
LRIDLKLQNPNGPDSRLRGNDGGRFFVFPDYSGLTKIRTRRGSRRQYK

SEQ ID NO: 7117 - DNA, 135 bp, Neisseria gonorrhoeae
ttgttaatccactataatcaggaaagacaaaaaaccttccgccgtcattcccgcgcaggcgggaatccggcccgttgggattttgcaacttcaaatcaatccgcaaaccggaatcccgtcattcccgcgcagtcg

SEQ ID NO: 7118 - protein, 45 aa, Neisseria gonorrhoeae
LLIHYNQERQKTFRRHSRAGGNPARWDFATSNQSANRNPVIPAQS

SEQ ID NO: 7119 - DNA, 1803 bp, Neisseria gonorrhoeae
atgccgtctgaaacggtcaaacgacgtttcagacggcatttttatgcccggttatttccggtatcggacggcgcgggacaggatttcttcaatttccatccacataatgcccccttacagcaaaccggcctgacccagtgcgggatcggtcgcgcggacggcttgtgcgtcttcgacggtcagtccgagggctttggctacgccttcaccgtatgccgggtcgcaacggtagcagttgcggatatggcggtatttgatgaagtcgggcgcatcgcccatggctgcggcggtgttgtcaaacaaagcctgtttctgcgcgtcgttcatcaggttgaacaaggcgcgcggttggctgaagtagtcgtcatcgtcttggcggtagtcccagtgtgccgcgtcgccgttgattttcaaaggcggttcggcgaagtcgggttgttgctgccattggccgaagctgttgggttcgtagtgcggcaggctgccgtagttgccgtcggcgcggccttgtccgtcgcgctggttgctgtgaacagggcaacgcggacgattgacggggatttggcggaagttcacacccaagcggtaacgttgcgcgtcggcgtaattgaacaaacgggcttgcaacattttatccgggctcgcgccgataccgggaacgaggttgctcggtgcgaaggcggattgttccacatcggcgaagaagttttcgggattgcggttcaactcgaattcgcccacttcaatcagcggatagtcttttttcggccaaactttggtcaagtcaaacggatgataaggcactttttcggcatcggcttcaggcatgacttggatgtacatcgtccatttcgggaactcgccgcgctcgatggcttcgtacaggtcgcgctgatggctttcgcggtcgtcggcgatgatttttgcagcttcttcgttggtcaggtttttaatcccttgctggctgcggaaatggaatttcacccaaaaacgttcgcccgcttcgttccagaagctgtaggtatgcgaaccgaagccgtgcatatggcggtagctggcgggaataccgcggtcgctcatcacgatggtaacttggtgcagggcttcgggcagcagcgtccagaagtcccagttgtttgtggcggaacgcatattggtgcgcggatcgcgtttgacggctttgttcaggtcggggaatttgcgcgggtcgcgcaggaagaacacgggcgtgttgttgccgaccacatcccagttgccttcttcggtatagaatttcaacgcaaaaccgcggatgtcgcgttccgcatcggctgcgccgcgctcgcctgccacggtggtgaaacgggcgaacatctcggtttttttgccgacttcgctgaaaattttggcgcgggtgtatttggtgatgtcgtgtgttacggtaaacgtaccgaacgcgcccgaacctttggcgtgcatacggcgttcggggatgacttcgcgcacgaagtcggcgagtttttcattcagccacaaatcttgcgtcagcagggggccgcgcgggccggcggtcaggctgttttgattgtcggcaacgggcgcgccgttgttcatggtcagatgggttacggggcatttggaggtagtcatcgctcttgttccttttctcaggttggtcaaatggggggcaaacggcttacagtacgatttggcggaaagcgtattcgtaaccggtttcttgattgtaataaatttcttgaatcgacattttattttccttttgcaaaaactatggatgcgattatacgccaagattttcgttat

SEQ ID NO: 7120 - protein, 601 aa, Neisseria gonorrhoeae
MPSETVKRRFRRHFYARLFPVSDGAGQDFFNFHPHNAPLQQTGLTQCGIGRADGLCVFDGQSEGFGYAFTVCRVATVAVADMAVFDEVGRIAHGCGGVVKQSLFLRVVHQVEQGARLAEVVVIVLAVVPVCRVAVDFQRRFGEVGLLLPLAEAVGFVVRQAAVVAVGAALSVALVAVNRATRTIDGDLAEVHTQAVTLRVGVIEQTGLQHFIRARADTGNEVARCEGGLFHIGEEVFGIAVQLEFAHFNQRIVFFRPNFGQVKRMIRHFFGIGFRHDLDVHRPFRELAALDGFVQVALMAFAVVGDDFCSFFVGQVFNPLLAAEMEFHPKTFARFVPEAVGMRTEAVHMAVAGGNTAVAHHDGNLVQGFGQQRPEVPVVCGGTHIGARIAFDGFVQVGEFARVAQEEHGRVVADHIPVAFFGIEFQRKTADVAFRIGCAALACHGGETGEHLGFFADFAENFGAGVFGDVVCYGKRTERARTFGVHTAFGDDFAHEVGEFFIQPQILRQQGAARAGGQAVLIVGNGRAVVHGQMGYGAFGGSHRSCSFSQVGQMGGKRLTVRFGGKRIRNRFLDCNKFLESTFYFPFAKTMDAIIRQDFRY

SEQ ID NO: 7121 - DNA, 192 bp, Neisseria gonorrhoeae
ttgcaacttcaaatcaatccgcaaaccggaatcccgtcattcccgcgcagtcgtgaatccgaacgcgtccgcacggaaatccgcatcccgtcattcccacgaaagtgggaatctagaatgtcaaatctcaagaaaccgttttatccgataagttcctatgccgacggacctggattcccgcctgcgcgggaa

SEQ ID NO: 7122 - protein, 64 aa, Neisseria gonorrhoeae
LQLQINPQTGIPSFPRSRESERVRTEIRIPSFPRKWESRMSNLKKPFYPISSYADGPGFPPARE

SEQ ID NO: 7123 - DNA, 114 bp, Neisseria gonorrhoeae; identical to SEQ ID NO: 4365

SEQ ID NO: 7124 - protein, 38 aa, Neisseria gonorrhoeae; identical to SEQ ID NO: 4366

SEQ ID NO: 7125 - DNA, 153 bp, Neisseria gonorrhoeae
atgaaccgggtcgaaacccattttatccagtatgccgccgacggctgtgccgcctgccgccccttcagacggcatttttgcggcaggcggcggggcgtatgccgtctgaacggcgcggcggcccgtgtcgggcgtatccttatttatagaata

SEQ ID NO: 7126 - protein, 51 aa, Neisseria gonorrhoeae
MNRVETHFIQYAADGCAACRPFRRHFCGRRRGVCRLNGAAARVGRILIYRI

SEQ ID NO: 7127 - DNA, 627 bp, Neisseria gonorrhoeae; identical to SEQ ID NO: 23

SEQ ID NO: 7128 - protein, 209 aa, Neisseria gonorrhoeae; identical to SEQ ID NO: 24

SEQ ID NO: 7129 - DNA, 348 bp, Neisseria gonorrhoeae
atgacggaggggaacggcgcacggacatttgccggaatcttttatgtttccattatcatactcttttcaatgcgctattccaggaaaaagaaaatagcttgtgcaggctgctttttgtttttcagacgacctgtaattaacggctgcttatccaatctgcttttcaaactacctgcaaccgcaaaatctgctgcaacccgcccctcccctgtgggggagggtttgggagagggcatttttcaagttgcggcaattcccccccgctcaaaaaattccctaaccgccccaatacaagccttgcggcttactgccctctctctaactctctcccacagggagagaggacta

SEQ ID NO: 7130 - protein, 116 aa, Neisseria gonorrhoeae
MTEGNGARTFAGIFYVSIIILFSMRYSRKKKIACAGCFLFFRRPVINGCLSNLLFKLPATAKSAATRPSPVGEGLGEGIFQVAAIPPRSKNSLTAPIQALRLTALSLTLSHRERGL

SEQ ID NO: 7131 - DNA, 564 bp, Neisseria gonorrhoeae; identical to SEQ ID NO: 4399

SEQ ID NO: 7132 - protein, 188 aa, Neisseria gonorrhoeae; identical to SEQ ID NO: 4400

SEQ ID NO: 7133 - DNA, 1194 bp, Neisseria gonorrhoeae
agttcggatacgctggtatctgccgccgggcattgcggcaacgctgccgtccaattccaattccaacagtgcggcatacaaatctgcggcaggcatagccaactgtccggcaagcacgtcgggatgaaccgggtcgaaacccattttatccagtatgccgccgacggctgtgccgcctgccgccccttcagacggcatttttgcggcaggcggcggggcgtatgccgtctgaacggcgcggcggcccgtgtcgggcgtatccttatttatagaatatgacgaagcacccgtattttgcaatagccccgggcattcgttcaggatgtcgtccaaacattccgtcagtttcgctccgtctttaatcagtttgtggcagcctttgctgtgggggttgtctatcgaaccgggtaccgccatcacttcgcgccccatttctgccgccaggccggcggtaatcagcgaaccggattccaaggcggcctcgaccaccagcgtaacctgcgacagcgcggcaatcaggcggttgcggcgcggaaagttgccggcatacggccgcgtgccgatggggaactcgctgacaatcagccctttttcggcgatttcataggcaaggtttttgttggccggcggataaatgcggtctatgcccgtcccccacacggcgacggtgccgccttctgcctccagtgcgccctgatgggcggcggtgtcgatgcccgaagccatacccgacacggtaggaatgcctttcccacccaacgccctgccgaaatctttggcaatccgcatcgcctgcggcgtggcatggcggctgccgacgatggcggcggaaggcttgtgcagcagccgcacgttgccgcgcaaaaacaaaaccggcggcgcggtcagcccctgcgtcagcatttcggggaaatcttcatcctgaagcagcatcaggcggcatccgtcccgcatttcccattccaacgccgcttctgccgcctgccgcgccaaagcgcgtttttccgcattgcgccaagcctcaagcgcgtgcttatgccgcaccgccggggcaacctgttccgccggtgcggacaaggcattttgcgcgctgccgaaactgcgcatcagcagcaggaaactttccgcgccgatatagggcgtaaacgccaattgcagccacgcgaaacgttcgtcctctgtcataaaatccat

SEQ ID NO: 7134 - protein, 92 aa, Neisseria gonorrhoeae
SSDTLVSAAGHCGNAAVQFQFQQCGIQICGRHSQLSGKHVGMNRVETHFIQYAADGCAACRPFRRHFCGRRRGVCRLNGAAARVGRILIYRI

SEQ ID NO: 7135 - DNA, 165 bp, Neisseria gonorrhoeae
atgccgtctgaaaggcttcagacggcgttttttttacacaatccccaccgtttcccatccttcccgatacaccgtaatcccgaaacccgtcattcccgcgcaggcgtgcatccgggtctgtcgggtttcggtttctccgatagattctcgctgcgttggggtttc

SEQ ID NO: 7136 - protein, 55 aa, Neisseria gonorrhoeae
MPSERLQTAFFLHNPHRFPSFPIHRNPETRHSRAGVHPGLSGFGFSDRFSLRWGF

SEQ ID NO: 7137 - DNA, 111 bp, Neisseria gonorrhoeae; identical to SEQ ID NO: 4411

SEQ ID NO: 7138 - protein, 37 aa, Neisseria gonorrhoeae; identical to SEQ ID NO: 4412

SEQ ID NO: 7139 - DNA, 1275 bp, Neisseria gonorrhoeae
ttcttcggttttttcccccgcccggcgcgaaacgccgatgccgagctgtttgagtttgcggtaaaggtgcgtgcgttccaaaccgaccttctgcgccactttgctcatattctgaccttcttgggcgatgtggtactcgaaataacgccgctccacctcctcccttaattcgcgcagcggcaggttaaagtcgaacccgcacgccatatgccccgttccgtcggcaggcacgccgcgccccagtgccgaagaagccgcgccgataccgatttcctgcccgtccgcctccagcagcagcgttgtcacgacgttttgcaactgctcgaaattccccggccagtcgtaacgggacaatacggcaagcgcatcgtcactgaatgcggtaggcgtgattttttggctttccgccacattgcaggcaatcccctgtatcaggaagggaatgtcttcatgctgcatactcaggggcggaatacggacgaccgattccgaaaaaagcccggccaatttttcttcacatgaaatgccgtctgaacctgccgcgtagctgcacgaagcaatcaccctgacacggcagcgttctgccttgccgatgataaaggtaatgccggtttggatattgcggctgtattgggcgatgtcgccgacatacaaaacgccgccctccgccttctgcaacagttccatcggcatatcgatcagatattcgacccttgccggactgacccacggcgtaccgtttttatggaaatagcgcgccacggtttcaaacggcgaacccgcctcgcccgtcaaaaatacaggggacgtgcgctttgccgccgcttcgacttcgcggttcatctcttgaatcgcggcactgttgcccagtttgtcgaacaccggtcccgtttcgatttgcgccgcaccgtgtttcaacgcgttttcgaccgcagacagcagcttttgcagggaaatcggtttttccaaaaaatcgatcgcgccgattttggtcgcttctacggcggtatcgatgctggcatgcccgctcatcaccaccaccggcatattgagctgcccgtttttcgcccactccttcaaaagggtgataccgtcgcaatcgggcatccaaatatccagcagcaccattgccgggcgcgcctgatggcgcagcttgcgcgcctcttcggcattttccgccaacgcgaccgaatagccttcgtcctgcaggatttccgacagcaggtcgcggatgccgacttcgtcgtctacaattaaaatatcgctgctacgcat

SEQ ID NO: 7140 - protein, 55 aa, Neisseria gonorrhoeae
FFGFFPRPARNADAELFEFAVKVRAFQTDLLRHFAHILTFLGDVVLEITPLHLLP

SEQ ID NO: 7141 - DNA, 2736 bp, Neisseria gonorrhoeae
atgcaacagcaacatttgttccgattcaatattttatgcctgtctttaatgactgcgctgcccgcttatgcagaaaatgtgcaagccggacaagcacaggaaaaacagttggataccatacaggtaaaagccaaaaaacagaaaacccgccgcgataacgaagtaaccggtttgggcaaattggtcaaaaccgccgacaccctcagcaaggaacaggtactcgacatccgcgacctgacgcgttacgaccccggcatcgccgtcgtcgaacaggggcgcggcgcaagctcgggctactcgatacgcggtatggacaaaaaccgcgtcgccttgacggtggacggcttggcgcaaatacagtcctacaccgcgcaggcggcattgggcgggacgaggacggcgggcagcagcggcgcaatcaatgaaatcgagtatgagaacgtcaaggctgtcgaaatcagcaaaggctcaaactcggtcgaacaaggcagcggcgcattggcgggctcggtcgcatttcaaaccaaaaccgccgacgatgttatcggggaaggcaggcagtggggcattcagagtaaaaccgcctattccggcaaaaaccgggggcttacccaatccatcgcgctggcggggcgcatcggcggtgcggaggctttgctgatccgcaccggccggcacgcgggggaaatccgcgcccacgaagccgccggacgcggcgttcagagctttaacaggctggtgccggttgatgacgcgagcacatacgcctatttcatcgttgaagaagaatgcaaaaacgagggttacgaaaagtgtaaagcgaaaaaagatgttgacggcaaagacgaacgtcaaacggtttccacccgagactacacgggccccaaccgcttcctcgccgatccgctttcatacgaaagccggtcgtggctgttccgcccgggttttcgttttgaaaacaaacggcactacatcggcggcatactcgaacgcacgcagcaaactttcgacacgcgcgatatgacggttccggcattcctgaccaaggcggtttttgatgaaaataaaaaatacggatcgataagaggctacggcaaatacgcgggcggccgcaaatacagcgggctgattaccaacggtgaaaacggtgcggaggtgggcgcggaatacggtacgggcgtgttttacgacgagacgcacaccaaaagccgctacggtttggaatatgtctataccaatgccgataaagacacttgggcggattatgcccgcctctcttacgaccggcagggcatcggtttggacaatcattttcagcagacgcactgttccgccgacggttcggacaaatattgccgcccgagtgccgacaagccgtcttcctactacaaatccgaccgcgtgatttacggggaaagccacaggctcttgcaggcggcattcaaaaaatccttcgataccgccaaaatccgccacaacctgagcgtcaacctcggttacgaccgttttggttccgacctccgccatcaggattattattatcaacatgccaaccgcgcctattcgttgaaaacgccccctcaaaacaacggcaaaaaaatcaaccccaacggcagcgaaaagaatccctattgggtcagcataggcgggggaaatgtggttacggggcaaatctgcctctttggcaacaatacttatacggactgcacgccgcgcagcatcaacggtaaaagctattacgcggcggtccgggacaatgtccgtttgggcaggtgggcggatgtcggcgcgggcttgcgctacgactaccgcagcacgcattcggacgacggcagcgtttccaccggcacgcaccgcaccctgtcctggaacaccggcatcgtcctcaaacctgccgactggctggatttgacttaccgcacttcaaccggcttccgcctgccctcgtttgcggaaatgtacggctggcggtcgggcggtaaaataaaagccgtcaaaatcgatccggaaaaatcgttcaacaaagaagccggcatcgtgtttaaaggcgatttcggcaacttggaggcaagttggttcaacaatgcctaccgcgatttgattgtccggggttatgaagcgcaaattaaagacggcaaagaacaagtcaaaggcgacccggcttacctcaatgcccaaagcgcgcggattaccggcatcaatattttgggcaaaatcgattggaacggcgtatgggataaattgcccgaaggttggtattccacatttgcctataatcgtgtccgtgtccgcgacatcaaaaaacgcgcagaccgcaccgatatccaatcacatctgtttgatgccatccaaccctcgcgctatgtcgtcggctcgggctatgaccaaccggaaggcaaatggggtgtgaacggtatgctgacttattccaaagccaaggaaatcacagagttgttgggcagccgggctttgctcaacggcaacagccgcgatacaaaagccaccgcgcgccgtacccgcccttggtatattgtggatgtgtccggttattacacggttaaaaaacacttcaccctccgtgcgggcgtgtacaacctcctcaaccaccgctatgttacttgggaaaatgtgcggcaaactgccgccggcgcagtcaaccaacacaaaaatgtcggcgtttacaaccgatatgccgcccccggccgcaactacacatttagcttggaaatgaagttc

SEQ ID NO: 7142 - protein, 912 aa, Neisseria gonorrhoeae
MQQQHLFRFNILCLSLMTALPAYAENVQAGQAQEKQLDTIQVKAKKQKTRRDNEVTGLGKLVKTADTLSKEQVLDIRDLTRYDPGIAVVEQGRGASSGYSIRGMDKNRVALTVDGLAQIQSYTAQAALGGTRTAGSSGAINEIEYENVKAVEISKGSNSVEQGSGALAGSVAFQTKTADDVIGEGRQWGIQSKTAYSGKNRGLTQSIALAGRIGGAEALLIRTGRHAGEIRAHEAAGRGVQSFNRLVPVDDASTYAYFIVEEECKNEGYEKCKAKKDVDGKDERQTVSTRDYTGPNRFLADPLSYESRSWLFRPGFRFENKRHYIGGILERTQQTFDTRDMTVPAFLTKAVFDENKKYGSIRGYGKYAGGRKYSGLITNGENGAEVGAEYGTGVFYDETHTKSRYGLEYVYTNADKDTWADYARLSYDRQGIGLDNHFQQTHCSADGSDKYCRPSADKPSSYYKSDRVIYGESHRLLQAAFKKSFDTAKIRHNLSVNLGYDRFGSDLRHQDYYYQHANRAYSLKTPPQNNGKKINPNGSEKNPYWVSIGGGNVVTGQICLFGNNTYTDCTPRSINGKSYYAAVRDNVRLGRWADVGAGLRYDYRSTHSDDGSVSTGTHRTLSWNTGIVLKPADWLDLTYRTSTGFRLPSFAEMYGWRSGGKIKAVKIDPEKSFNKEAGIVFKGDFGNLEASWFNNAYRDLIVRGYEAQIKDGKEQVKGDPAYLNAQSARITGINILGKIDWNGVWDKLPEGWYSTFAYNRVRVRDIKKRADRTDIQSHLFDAIQPSRYVVGSGYDQPEGKWGVNGMLTYSKAKEITELLGSRALLNGNSRDTKATARRTRPWYIVDVSGYYTVKKHFTLRAGVYNLLNHRYVTWENVRQTAAGAVNQHKNVGVYNRYAAPGRNYTFSLEMKF

SEQ ID NO: 7143 - DNA, 144 bp, Neisseria gonorrhoeae
ttgcggaaaatcaatattttattttcaatagctttacacaataataccgatagagaatcaagtttaacaaaatgccgtctgaaaccggtaaagcttcagacggcattttattttccgacatcattgaatcaaacccaaatgcga

SEQ ID NO: 7144 - protein, 48 aa, Neisseria gonorrhoeae
LRKINILFSIALHNNTDRESSLTKCRLKPVKLQTAFYFPTSLNQTQMR

SEQ ID NO: 7145 - DNA, 2151 bp, Neisseria gonorrhoeae
cgcataagtttctaccgtttttggcaagatgattctgacacacgccccacccgcatcctgattgctcaggctgatgcggccgccgtgttctccaatgatttttttcactacaggcagacccagtcccgttcccgccggcttatccgtcacatacggctcgaaagcattgtgcagcatttccttgccgaatcccttgccgttgtcgcaaaccgtcaggacaatccgtccgtcctgccccgtttccgattttaccctgacttcgggcatatcggcttcttccgccgcttcggcggcatttttgaaaatattgtgcagcacctgccgcatggcggtcgtatccgccgccatcatcagcggttcgccggcaagttccgcctcaaaccggcacgggccggcttcgtacagggccaaaacatcgccgattaaggcgttcaaatcctgattttccagtttgagcgaaggggcgcgcgcgtaattgcggaatgcctcgaccatttcttttaacgccgccacctgtttgatgatggtgtcggtcgaacgcgtcaggatttgcgcgtcctgatcgtccagcttcccgcccaatttccacgccagccgttcggcggaaagctggatgggcgtgagcggattgcggatttcgtgtgccagccgcttcgccacttcaccccacgcggcttctttttgcgcgcgtatcagcacggtgatgtcgtcaatcaccatcaccacgccgttgccgttgtcttcgggcaataccgtcgccttgcccagcaggattttggcatcgtccggcgcggcatattccacctggaccggtttgtccgtacctgccgccgcaccgatggcggcaaacacttcggcaagcagggactgctgcgccgaaacgccgtgccaaccgtgccggctgctgccccacaggggggcgagcggcatccccaaaatctgttccgccgccttgttgaaggttttcaaacggcctttttcgtcaaacaccaccacaccggtagtcaacccatccaacacgcactcgaggtagtgacgggcggcttcctcgcgccggcggttgcgttcgtctgcttctttggcgatggaaagctgctcggtcatatggttgaacagcttggtcaaacgtccgaactcgtcgttgcgcaatacggggcgcgtctggctgaaatcaccctgcgccaccgcctttgcgccctcggcaagcgacagaatgggttcgacgaaacggcgggcaaaatacagtgccattaccagcgcaagaaaaatcgacagcagcgaggcaatcagcagggttaccagaaaaaaggtctgcaaaccttttttgctgtaactcaattcggcatatttcgcccgcgccttttcaatcagaacggcatcctgtgccacattttcgggaatcggctggcggaagaacagcgcgtaatcgcgcccgttgtgcgtacctgccgacaaccatccctgcgcgtacaatacgccgcctatgctttccaaactccgaaccgaaccggtctgctgaatctgttcccaatgttctttgtcgggaagcggctggtcgaattggtgcggattgatgcttttttcgattttcccgcttgcggcattgtacagggcaagctgggcaaaaccgctgccggcgtagtgttccagcacactgcccatattgcccgacagggaggcggtgccgatgaggtctatctgtacgggaacggcgttgctgacggcattgtctgccgccaaatccagtgcggacttgctcaaattaaggctgcgttcgagggcttcgtgggtgtcgttgccgaaccacgaattaatcgtgccgttgataaactgcgcggaaatgccgaacaggaacaagccgggcagtacggcgaccagcgtgaacatcccggaaaggcgtttggcaatctgcgaaccgaacacgccgttgcgcctgtctttcaacagcaatatgacataacgtgccaaaacggcggacaacaccagcagcagcattgcgctgaacgagactatccaccagaaataatccgccagcgaactggtgctgccggtcgccgccgtcaatccgtacagcaggacgacggcgcatatggctgcgatcggtaggaagcggcgcattatttgttcccgatgatgtttagaggtttccaa

SEQ ID NO: 7146 - protein, 141 aa, Neisseria gonorrhoeae
RISFYRFWQDDSDTRPTRILIAQADAAAVFSNDFFHYRQTQSRSRRLIRHIRLESIVQHFLAESLAVVANRQDNPSVLPRFRFYPDFGHIGFFRRFGGIFENIVQHLPHGGRIRRHHQRFAGKFRLKPARAGFVQGQNIAD

SEQ ID NO: 7147 - DNA, 153 bp, Neisseria gonorrhoeae
ttgaaagacatcgtgtattccttatgggaggttaaaatcattgttcaaaccggcaggcaaacctgttctgccgattatttcttcagtgtacctatcgcacctttagccatctttgcggaaaatcaatattttattttcaatagctttacacaa

SEQ ID NO: 7148 - protein, 51 aa, Neisseria gonorrhoeae
LKDIVYSLWEVKIIVQTGRQTCSADYFFSVPIAPLAIFAENQYFIFNSFTQ

SEQ ID NO: 7149 - DNA, 1161 bp, Neisseria gonorrhoeae; identical to SEQ ID NO: 49

SEQ ID NO: 7150 - protein, 387 aa, Neisseria gonorrhoeae; identical to SEQ ID NO: 50

SEQ ID NO: 7151 - DNA, 597 bp, Neisseria gonorrhoeae
tttgttcccgatgatgtttagaggtttccaacccgaatccaaatgccagttttgagaagtcaatgcgttgatttggaaaggcttgggcagttttgaagtggacagcgtcaggcggatttccgccttggtttcccctgcttccgcaccggacaacgcgcctttgttcaggactttccagttggcaaccgcgccggtcgcgcgcaatgccgcatccaaagtgtcgtaatcggtggaaaatgcgccgacggtaacgcggtagcggttggtcagcggatggaaacttagtttgtagtcaatattgtcgtcatcgccaatcagttgccccaatttaaaccgataagaagcgattgtcggggcggaaagctgccagcttaaggtaaagttgagcggtacgccccggcgcaacgcctgttggagctggtcgggcagctcggtttggaagcggctgctgatggaaagccgcccgccgtcggttatcctcgcttcggcgcgggtcgcggcaatgccctccgccgccgcgtccggcaaaacggagagtatcggcaacagcacaagccattgtttaatgcttttgaataagcgcgtaataaaagccat

SEQ ID NO: 7152 - protein, 6 aa, Neisseria gonorrhoeae
FVPDDV

SEQ ID NO: 7153 - DNA, 996 bp, Neisseria gonorrhoeae; identical to SEQ ID NO: 3867

SEQ ID NO: 7154 - protein, 332 aa, Neisseria gonorrhoeae; identical to SEQ ID NO: 3868

SEQ ID NO: 7155 - DNA, 225 bp, Neisseria gonorrhoeae
ttgatttttttatcggctgttgcttttgattcgctaaatttgccgaaattcaaattcaaatcctccggatgtattttttcgggcattgtgcggacaaatcgccgttttgtcctttgtcaggttttgtgcatatcgggaaaaccgaaatcgtccgcacctgtgccggtgtcgattcgtcccttgccatctcgggatatatccagcaaaatcggcatatcggtattt

SEQ ID NO: 7156 - protein, 75 aa, Neisseria gonorrhoeae
LIFLSAVAFDSLNLPKFKFKSSGCIFSGIVRTNRRFVLCQVLCISGKPKSSAPVPVSIRPLPSRDISSKIGISVF

SEQ ID NO: 7157 - DNA, 2109 bp, Neisseria gonorrhoeae
atgaacaatccattggtgaatcaggctgctatggtgttgcctgtgtttttgttgagcgcttgtctgggcggaggcggcagtttcgatcttgattctgtcgataccgaagccccccgtcccgcgccaaagtatcaagatgttccttccaaaaaaccggaagcccgaaaagaccaaggcggatacggtttcgcgatgcgcttcaagcggcgcaattggtatccgccgtcaaatcctaaagaaaatgagataagactctctgaaggtgattgggaacaaacgggtaatggtaatatcaaaaacccttccaaacaaaaaaatattattgatgccttatctggaaatggggaggcaccattgcaagattccagtcaacaaggtgagggtatatctaaggttacggactatcacgattttaaatacgtatggtcgggttttttttataaacagattgggaatacaattaaaaaagacgattcatctagtaaaataatcgaagccagaaacggtcctgacggttatattttttataaaggcacagatccctcgagaaaacttcctgtttcagggagtgttgagtacaaaggtacttgggattttttaactgatgtgcaagcaaatcagaaatttacagatttagggagtgcttttacgaagtccggcgacagatatagtgctttttccggggagttggattatatagtcaggaaagaggaggataaaaaagacgggcacgtaggtttgggattaacaacggaaataacggttaattttgagaaaaaaaccctgagcggaaaattaattaaaaacaacatggtaatcaataatggcgatgaacccaccacccaatactacagccttgaggctcaagtaacaggcaaccgcttcaacggcaaggcgatggtaaccgacaaacccgaaaacagcaaaagtaaacaacatccctttgtttccgactcgtcttctctgagcggcggctttttcggcccgcagggtgaggaattgggtttccgctttttgagcaacgacaacaaagttgccgttgtcggcagcgcgaaaaccaaagacgaaaccgcaagcagtggcggcacttcgggcggtgcaagcgtttccgcatcaaacggtgcgacaggcacgtcgtctggaaacagtaatctgaccacggttttggatgcggttgaattgacaccagacggcaaggaaatcaaagatctcgacaacttcagcaacgccgcccaactggttgtcgacggcattatgattccgctcctgtccaccgaaagcgggaacggtcaggcagataaaggtaaaaacggtggaacagactttacctacacaacaacctacatgccggaaagtgataaaaaagacaccaaagcccaaacaggcgcgggcggcatgcaaaccgcttcggatgcggcgggcgttaacggcgggcaggcaggaacaaaaacctataaagtcgaagcctgctgttccaacctcaattatctgaaatacgggttgctgacacgcgaaaacagcaattccgtgatgcagacagtcagaaacagtagccaagccgccgcccgaacggcacagggtgcacaaagtatgttcctccaaggcgagcgcaccgatgaaaaagaaattccaaaagaacaaaaagtcgtttatctaggcacttggtacgggcatattgccgccaacggcacaagctggaccggcaacgcctccgatcagcaaagtggtaatcgggcaaagtttgacgtgaatttcaaagacaaaaaaattaccggcacgttaaccgctgcaaacaggcaggaggcaacctttaccattgatgccatgattgatgacaacggctttaaaggtacggcgaaaaccggtaatgacggatttgcgccggatcaaaacagtagcaccggtacatataaagtgcacatcgcaaatgccgaagtgcagggcggtttttacgggcctaacgccgaagagttgggcggatggtttgcctatccgggcaatggacaaacgaaaaatgcgcaagaaaatgcgcaagcttcatccggcaatggaaattcagcagtcagcgcgaccgtggtattcggtgcgaaacgccaacagcttgtgaaa

SEQ ID NO: 7158 - protein, 703 aa, Neisseria gonorrhoeae
MNNPLVNQAAMVLPVFLLSACLGGGGSFDLDSVDTEAPRPAPKYQDVPSKKPEARKDQGGYGFAMRFKRRNWYPPSNPKENEIRLSEGDWEQTGNGNIKNPSKQKNIIDALSGNGEAPLQDSSQQGEGISKVTDYHDFKYVWSGFFYKQIGNTIKKDDSSSKIIEARNGPDGYIFYKGTDPSRKLPVSGSVEYKGTWDFLTDVQANQKFTDLGSAFTKSGDRYSAFSGELDYIVRKEEDKKDGHVGLGLTTEITVNFEKKTLSGKLIKNNMVINNGDEPTTQYYSLEAQVTGNRFNGKAMVTDKPENSKSKQHPFVSDSSSLSGGFFGPQGEELGFRFLSNDNKVAVVGSAKTKDETASSGGTSGGASVSASNGATGTSSGNSNLTTVLDAVELTPDGKEIKDLDNFSNAAQLVVDGIMIPLLSTESGNGQADKGKNGGTDFTYTTTYMPESDKKDTKAQTGAGGMQTASDAAGVNGGQAGTKTYKVEACCSNLNYLKYGLLTRENSNSVMQTVRNSSQAAARTAQGAQSMFLQGERTDEKEIPKEQKVVYLGTWYGHIAANGTSWTGNASDQQSGNRAKFDVNFKDKKITGTLTAANRQEATFTIDAMIDDNGFKGTAKTGNDGFAPDQNSSTGTYKVHIANAEVQGGFYGPNAEELGGWFAYPGNGQTKNAQENAQASSGNGNSAVSATVVFGAKRQQLVK

SEQ ID NO: 7159 - DNA, 153 bp, Neisseria gonorrhoeae; identical to SEQ ID NO: 4505

SEQ ID NO: 7160 - protein, 51 aa, Neisseria gonorrhoeae; identical to SEQ ID NO: 4506

SEQ ID NO: 7161 - DNA, 1257 bp, Neisseria gonorrhoeae
atgcttttgaataagcgcgtaataaaagccatcttggtgtttgttcggtaaaagcacccgcgattcgatcggttcggcatcggcatggcggttgaggaatttttgcagttgcccgtcgttttcttcgacgaacacggaacaggtggcaagcagcattctgccgccctgtttcaacgcctgccaaagtgcgtccagcagggcttcctgctggcgggcggttttgagcgcgtcggtcggtcggcgcagccatttcacgtcgggattgcgccgcgccacgccggaagcggtgcacggcacgtcggcaaggattgcgtcgaaaggctttccatcataccacgccgccaaatcccgcgcatcggcacacgccgccgatgccgtctgaaagcccaaacgggcgatattgtcctccacacgcttcagacggcctgcatcgatgtccaaggcggtaacgcggcagtccgccagttccaaaatatgccccgtcttgccgcccggcgcggcgcacgcgtccaaaatccgttcgccgtctttcgggttaaggagatacgccgcctgctgcgcgccgaagtcctgtaccgacaccagtccttcggcaaaaccgggcagacggtttaccggcacggcttcttccaacgtaaccgcatattcgtccaacgccttagccgcgataccttccgccaccagtttttccaaatagctttcggcattgccgtgccggcggttgacgcgcaacgtcatcggcggatgggattgcagcgcggcggcgatgttgtgccagtgtttcggataatggtttttcaagtaagccacccaccacagcggcaggttgtgtttcgccacatcgtcttttttgcaggaagccgccaatttttcacgttcgcgcaaaaagcggcgcaaaaccgcgttggcaaacgaacggtactgcccgcgcccgattttggctatgctttcaacagcttcgttgaccacggcgtggggcgcgttgcgcgtgtaatgcagttggtacaacgccgccaaaagcaggctttcgagctgcggattgtcgatgggctttttcagcatctgcgcgagcatatgtttcaaactgcccaaataacgctggcagccgtaggcgatatcctgcaacgcgccgttttcctgcgccgtcagctgcggatgcgccgcgcggatgtgcgccaacacgtcctgaaggttgcgcccttcggcaaccgccgcaatgctgtcggcggcaagtttttgggcaagtgccatactcat

SEQ ID NO: 7162 - protein, 16 aa, Neisseria gonorrhoeae
MLLNKRVIKAILVFVR

SEQ ID NO: 7163 - DNA, 141 bp, Neisseria gonorrhoeae
ttgggaaagattgccgcaacttggaaagtgccctctccccagccctccgccgcgcaggggagggagcggattgcagcaggtttggcggttgcaggcggttttaaaagcagcgcgggaatgacggtattttggtttatttac

SEQ ID NO: 7164 - protein, 47 aa, Neisseria gonorrhoeae
LGKIAATWKVPSPQPSAAQGRERIAAGLAVAGGFKSSAGMTVFWFIY

SEQ ID NO: 7165 - DNA, 960 bp, Neisseria gonorrhoeae
cagcttcgcccctgcttcaatagaccgtcccgccgcaaacgccgcaatattcatacgcctgccgccggcaggctgcaattcggtaatcttcagcgcgctttcgccgcaggcaacgaccaaaccgtccgccgaacaggacaacacttcgcctgccgtaccttgttgcgccaccacttcggcacgccggattttcatcggcttgccctgatattcgacccacgcggcaggcacggggttgaaggcgcggattttgcgttcgataatgtccgcgctttcgctccaatcgatacgcgcttcttctttgcttagtttttgggcgtaagttacgccttcttcgggctgtttgaccgcgttcagacggcctttgctttgaagctgttgcaaatcggcaacaaccgccgccgcaccgatttccatcagcgcgtcgtggacttcgttggcggtatcggtaggttggatggcgtagcggtgttcgctgaccacatcgccggtgtccaaaccgatgtccatctgcataatgcacacgccggtttcggcatcgccggcctcaatcgcgcgctgaatcggcgccgcgccgcgccaacggggcagcagcgaagcgtggatattgaggcagccgtgtttcggcgtatccaacacttcctgcggcagaatcaagccgtacgcggcaaccaccattacgtccgcctcgacctctttgagcatttgcagggcttcggcgttgttgcgcagtttttcgggctgtgccacgcgcaaaccgagttccagcgcggcttgtttgacaggcggggcggtcagttgcataccgcgccctttcggacggtcgggctgggtcagcaccagcgggatttcaaaaccggcggcggcaacggcttttaaggcggcggcggcaaaatcgggcgtgccggcaaagatgactttcatagcgtgttcctgcgtgtgcgtaaagttgtcggacaa

SEQ ID NO: 7166 - protein, 102 aa, Neisseria gonorrhoeae
QLRPCFNRPSRRKRRNIHTPAAGRLQFGNLQRAFAAGNDQTVRRTGQHFACRTLLRHHFGTPDFHRLALIFDPRGRHGVEGADFAFDNVRAFAPIDTRFFFA

SEQ ID NO: 7167 - DNA, 159 bp, Neisseria gonorrhoeae
ttgccgcaactcggagaatgccctctccccggccctcccccacgggggagggagcggattgcggcagattttgcggttgcaggcggtttgaaaagcaacttggatttaccgttgatttcaggtcgtatgaaaaataaaaaacagcctgcacaagctgat

SEQ ID NO: 7168 - protein, 53 aa, Neisseria gonorrhoeae
LPQLGECPLPGPPPRGRERIAADFAVAGGLKSNLDLPLISGRMKNKKQPAQAD

SEQ ID NO: 7169 - DNA, 2073 bp, Neisseria gonorrhoeae
atgccgtctgaagcacaacacgcaaaggaaacccatcttatgattgacaacgcactgctccacttgggcgaagaaccccgttttaatcaaatcaaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtagaatgggacgcggtcgaactgcccagccagtttatggaaaacttcgtttgggaatacaatgtattggcacaaatgtccgcccacgaagaaaccggcgagcccctgccgaaagaactcttcgacaaaatgctcgccgccaaaaacttccagcgcggtatgttcctcgtccggcaaatggagttcgccctcttcgatatgatgatttacagtgaaagcgacgaatgccgtctgaaaaactggcagcaggttttagacagcgtgcgcaaagaagtcgccgtcatccaaccgcccgaatacaaccgcttcgccaacagcttcggccacatcttcgccggcggctattccgcaggctattacagctacgcatgggccgaagtcctcagcaccgatgcctacgccgcctttgaagaaagcgacgacgtcgccgccacaggcaaacgcttctggcaagaaatccttgccgtcggcggctcccgcagcgcggcggaatccttcaaagccttccgcggacgcgaaccgagcatagacgcactgctgcgccacagcggcttcgacaacgcggct

SEQ ID NO: 7170 - protein, 691 aa, Neisseria gonorrhoeae
MPSEAQHAKETHLMIDNALLHLGEEPRFNQIKTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVEWDAVELPSQFMENFVWEYNVLAQMSAHEETGEPLPKELFDKMLAAKNFQRGMFLVRQMEFALFDMMIYSESDECRLKNWQQVLDSVRKEVAVIQPPEYNRFANSFGHIFAGGYSAGYYSYAWAEVLSTDAYAAFEESDDVAATGKRFWQEILAVGGSRSAAESFKAFRGREPSIDALLRHSGFDNAA

SEQ ID NO: 7171 - DNA, 339 bp, Neisseria gonorrhoeae
ttgccgcaactcggagaatgccctctccccggccctcccccacgggggagggagcggattgcggcagattttgcggttgcaggcggtttgaaaagcaacttggatttaccgttgatttcaggtcgtatgaaaaataaaaaacagcctgcacaagccgtattagtttgcataaaccttaaccccaacagccaccccgtcctctctccctgcgggagagagttagagagagggcagcaagccgtattagtttgcataaaccttaaccccaacagccaccccgtcctctctccctgcgggagagagttagagagagggcaacaagccgcaaggtttgtattt

SEQ ID NO: 7172 - protein, 113 aa, Neisseria gonorrhoeae
LPQLGECPLPGPPPRGRERIAADFAVAGGLKSNLDLPLISGRMKNKKQPAQAVLVCINLNPNSHPVLSPCGRELERGQQAVLVCINLNPNSHPVLSPCGRELERGQQAARFVF

SEQ ID NO: 7173 - DNA, 543 bp, Neisseria gonorrhoeae
aatcgtatgtttctgacgttttttcagtttggtcttaatccgcccctgcttgagttgggaaaggcgttcgacaaacacgatgcccatcaggtgatctaactcgtgctgcacgcaaatcgccagcagcccgtccgcctccagcgtgaatttttcgcctttttcgttcaaagcctcgaccttgacgcgttcggcgcgggtaacggcgtcgtaaatgcccggtacggacaggcagccctcttcgtaagtggtttcgccgtctttttcaacgatgacggggttgatgaacacgcgcggttcgctgcggtcttcggtcaaatccatcacgaccacgcgttcgtgcacatcgacctgcgtcgccgccagcccgatgccgcgcgattcgtacatcgtttcaaacatatcggcaaccagcttccggatgcgctcgtcaacttgttcgacaggctttgccaccgtgtgcagacgctcgtcgggatattgcaagatattcagtaaagccataattttctctttccttcggcggatacgccgcctgtttttcat

SEQ ID NO: 7174 - protein, 32 aa, Neisseria gonorrhoeae
NRMFLTFFQFGLNPPLLELGKAFDKHDAHQVI

SEQ ID NO: 7175 - DNA, 99 bp, Neisseria gonorrhoeae
atgcaggtttccgtatggatggattcgtcattcccgcgcaggcgggaatccgaacctgtcggaacagaaacttatcggataaaacggtttcttgagatt

SEQ ID NO: 7176 - protein, 33 aa, Neisseria gonorrhoeae
MQVSVWMDSSFPRRRESEPVGTETYRIKRFLEI

SEQ ID NO: 7177 - DNA, 150 bp, Neisseria gonorrhoeae
atgttaaaatgcggaacatttgttatcacacggcacatcccgaggggctgccgccgctttttccaacccaatcaagcaagacaaaccgaaatttatcagataaggggaacggttatgcaacgtcgtattataaccctgctctatattcag

SEQ ID NO: 7178 - protein, 50 aa, Neisseria gonorrhoeae
MLKCGTFVITRHIPRGCRRFFQPNQARQTEIYQIRGTVMQRRIITLLYIQ

SEQ ID NO: 7179 - DNA, 969 bp, Neisseria gonorrhoeae
ttgcggccggtacgggcgcggaatttgccggcaaagtggcaaaagcgtttttttgccactaaaatctacaccctatacttttcggacaggggcgcggaaatggaaatatggaatatgttgaacacttggcccgatgccgtcccgatacgcgcggaggcggccgaatccgtggcggcggtcgcggctttgctgctggcgcgcgcccttctgttgaatatccacttcagacggcatccggatttcggcatcgaaagcaagcggcggtttttggttgccagccgcaatataacgctgcttttggtgctgttttcgctggcatttatctggtcggcgcaaattcaaacgctggctttgtcgatgtttgcggtggcggcggcggtcgtcgtggcgacaaaagaactgattatgtgtctgtcgggcagtattttaaggtctgccacccagcaatactcggtcggcgactatatcgaaatcaacggcctgcgcgggcgcgtggtcgacatcaatctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccattcagcggtatttggaaaacgtgcaggcggaaaaactgtttatcacgcccgccgccaggccgcgcgttacccgcgtaccgtacgacgacaaggcataccgcatcatcgtccgcttcgcctcccccgtttcaaagcggctggaaatccaacaggcggttatggacgaatttttgcgcgtacaataccgcctgttaaatcatcccgccggctccgaaacactt

SEQ ID NO: 7180 - protein, 323 aa, Neisseria gonorrhoeae
LRPVRARNLPAKWQKRFFATKIYTLYFSDRGAEMEIWNMLNTWPDAVPIRAEAAESVAAVAALLLARALLLNIHFRRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRYLENVQAEKLFITPAARPRVTRVPYDDKAYRIIVRFASPVSKRLEIQQAVMDEFLRVQYRLLNHPAGSETL

SEQ ID NO: 7181 - DNA, 2613 bp, Neisseria gonorrhoeae; identical to SEQ ID NO: 4587

SEQ ID NO: 7182 - protein, 871 aa, Neisseria gonorrhoeae; identical to SEQ ID NO: 4588

SEQ ID NO: 7183 - DNA, 195 bp, Neisseria gonorrhoeae
aaatgcggaacatttgttatcacacggcacatcccgaggggctgccgccgctttttccaacccaatcaagcaagacaaaccgaaatttatcagataaggggaacggttatgcaacgtcgtattataaccctgctctatattcagtaaagccataattttctctttccttcggcggatacgccgcctgtttttcat

SEQ ID NO: 7184 - protein, 48 aa, Neisseria gonorrhoeae
KCGTFVITRHIPRGCRRFFQPNQARQTEIYQIRGTVMQRRIITLLYIQ

SEQ ID NO: 7185 - DNA, 90 bp, Neisseria gonorrhoeae
ttgctcccgataaatgccgcaatctcaaatcccgtcattcccgcgcaggcgggaatccggaccttcaatgctaaggcaatttatcgggaa

SEQ ID NO: 7186 - protein, 30 aa, Neisseria gonorrhoeae
LLPINAAISNPVIPAQAGIRTFNAKAIYRE

SEQ ID NO: 7187 - DNA, 162 bp, Neisseria gonorrhoeae
atgacgggatttgagattgcggcatttatcgggagcaacagaagccgctctgccgtcattcccgcgaaagtgggaatccggttttttgagtttcagtcattcccgataaattgccttagcattgaaggtccggattcccgccttcgcgggaatgacgggatt

SEQ ID NO: 7188 - protein, 54 aa, Neisseria gonorrhoeae
MTGFEIAAFIGSNRSRSAVIPAKVGIRFFEFQSFPINCLSIEGPDSRLRGNDGI

SEQ ID NO: 7189 - DNA, 1647 bp, Neisseria gonorrhoeae; identical to SEQ ID NO: 4611

SEQ ID NO: 7190 - protein, 549 aa, Neisseria gonorrhoeae; identical to SEQ ID NO: 4612

SEQ ID NO: 7191 - DNA, 1335 bp, Neisseria gonorrhoeae
atgttaaaatgcggaacatttgttatcacgcggcacatcccgaggggctgccgccgctttttccaacccaatcaagcaagacaaaccgaaatttatcagataaggggaacggttatgcaacgtcgtattataaccctgctctgcgcggcaggtatggcattctcaacacaaactttggcggcaaatctggaggtgcgcccggatgcgccgcaacgctacacggtcaaacagggcgacaccctgtggggtatttcgggcaaatacctgtacagcccgtggcaatggtgccgcctgtggggcgcgaaccgggatcaaatccacaatcccgacctgatttatccgggccaggtattggtgttgcgctacgttggcggcgaaccgcgcctcggcttggaacagacagacggcatccccgtcgtcaaaatcagtccggataaggaagtgtccggatacggtattcccgccatcgatgtcaacttctaccgcgtctttatgcagcacccgcaaatcgtttcccgcaaagaaaccgctgccgcgccgcgcctgctctcgggcccggaaggcaggctgctgtacaccaaaggcgccagggtttacaccaaaggcctgaaagaaccgggccgttatctgacctaccgaatcaataaaaacatcaccgatccggatacgggtaaattcctcggacaagaagtcgcattcagcggcatcgtgcgctccctcgactataccgactccgccctcgaacaacgctcgaaacaggctgaagaacggctgaaagacaacgaatactacacccgcacccatcctttgattaccccggtgcgcacccgttcgatacagccgctggtggtcgaaaccgccatttccgaaatacagcagggcgactacctgatgaaaatgccggaagacaccgaccgcttcaatatggtgccgcacgaaccgtcccgcccggttcaggcaaaaatcgtttccgtgtttgaaggcgtgggggtcggcggacagttcaaaaccattacgatagacaaaggcggggacgacggtttggacaaaggcgcagttttaagcctttacaaacgcaagaaaacgatgcaggtcaacctctccaacaatttgaccgaagaacctaaaagcagggataccgtcgagctgatttcgacacctgccgaagaagtgggcttggcaatggtttaccacactgcgccgaaactggcttacgccattattttggaaaacatctccgatatttccgaaggcgacaccgccgccaatccgggacgggatttggacaatatgccggatcagggccgcgcccgcgtcgattccgaccctttccaa

SEQ ID NO: 7192 - protein, 445 aa, Neisseria gonorrhoeae
MLKCGTFVITRHIPRGCRRFFQPNQARQTEIYQIRGTVMQRRIITLLCAAGMAFSTQTLAANLEVRPDAPQRYTVKQGDTLWGISGKYLYSPWQWCRLWGANRDQIHNPDLIYPGQVLVLRYVGGEPRLGLEQTDGIPVVKISPDKEVSGYGIPAIDVNFYRVFMQHPQIVSRKETAAAPRLLSGPEGRLLYTKGARVYTKGLKEPGRYLTYRINKNITDPDTGKFLGQEVAFSGIVRSLDYTDSALEQRSKQAEERLKDNEYYTRTHPLITPVRTRSIQPLVVETAISEIQQGDYLMKMPEDTDRFNMVPHEPSRPVQAKIVSVFEGVGVGGQFKTITIDKGGDDGLDKGAVLSLYKRKKTMQVNLSNNLTEEPKSRDTVELISTPAEEVGLAMVYHTAPKLAYAIILENISDISEGDTAANPGRDLDNMPDQGRARVDSDPFQ

SEQ ID NO: 7193 - DNA, 168 bp, Neisseria gonorrhoeae
ttggcctccatgtattcaatcgtggaaatctatatcttcgtcctcgccgaaatagtctatgcccgatatacaattttgatacacaaacttggaaatatgggtatcgtcgccggagcgatagaatgcggacagttatatatatacggtttttttaggggagcgggcaga

SEQ ID NO: 7194 - protein, 56 aa, Neisseria gonorrhoeae
LASMYSIVEIYIFVLAEIVYARYTILIHKLGNMGIVAGAIECGQLYIYGFFRGAGR

SEQ ID NO: 7195 - DNA, 123 bp, Neisseria gonorrhoeae
atgcccgaaaaaatacatccggaggatttgaatttgaatttcggcaaatttagcgaatcaaaagcaacagccgataaaaaaatcaaaagtttatttcaatgtttcaacacacaggacgacaca

SEQ ID NO: 7196 - protein, 41 aa, Neisseria gonorrhoeae
MPEKIHPEDLNLNFGKFSESKATADKKIKSLFQCFNTQDDT

SEQ ID NO: 7197 - DNA, 216 bp, Neisseria gonorrhoeae
atgagtatgcccgaaatgcccaaatggtacggcgatgacggacagatcgtatcctgtaccgaaaaggtcaaagtgatgtccgaaaatatggccgagctgtatcagacggcacaagacgcgtttgaagacgcgctgctgatgggttgcggcgaacgtcagttgcgcgcttacctgctcgcgctgattgaaggtttggaaaatccctaccgcaaagtc

SEQ ID NO: 7198 - protein, 72 aa, Neisseria gonorrhoeae
MSMPEMPKWYGDDGQIVSCTEKVKVMSENMAELYQTAQDAFEDALLMGCGERQLRAYLLALIEGLENPYRKV

SEQ ID NO: 7199 - DNA, 165 bp, Neisseria gonorrhoeae
ttgatgcaaaaccctgatttagtcggacaaaatgccttttatccgatggaatcggtttccgcccgaacggaaatcacagcggctgtctcccttgcagacagatatagcgaattaacaaaaaccggtacggcgttgccccgccccggctcaaagggaacgattccc

SEQ ID NO: 7200 - protein, 55 aa, Neisseria gonorrhoeae
LMQNPDLVGQNAFYPMESVSARTEITAAVSLADRYSELTKTGTALPRPGSKGTIP

SEQ ID NO: 7201 - DNA, 129 bp, Neisseria gonorrhoeae
atgcaaattgacttttgcgggcggttttaccgcccatatatttacaaaagccaaatttttaaacatatatccttgatatatacacggcgtaaacatatactggaaacatctttaaattttccgaaattt

SEQ ID NO: 7202 - protein, 43 aa, Neisseria gonorrhoeae
MQIDFCGRFYRPYIYKSQIFKHISLIYTRRKHILETSLNFPKF

SEQ ID NO: 7203 - DNA, 162 bp, Neisseria gonorrhoeae
ttgcgggtttaccgcttcaacgccaacgtcaacacgcccgccgtaaccagccccaagcctatccattcctgcgtgttcgggcgttcgtccaagaaaaccaccgccatcaggaatgcaaaccggcgttgtttgcagcatccggcaagaatttttatagtggat

SEQ ID NO: 7204 - protein, 54 aa, Neisseria gonorrhoeae
LRVYRFNANVNTPAVTSPKPIHSCVFGRSSKKTTAIRNANRRCLQHPARIFIVD

SEQ ID NO: 7205 - DNA, 1107 bp, Neisseria gonorrhoeae
atgagcaactggaaacccgatattccctataacgatttaccacccctgccgccaaaacaggatattgaaagcaaaaccatcctgaaacgttgtatagccgcccgtgcatcccttgcccgtttaaagcaggcggcagaattgataccgaatcaagccatgctgattaacacccttcctgttatggaagcccgtgcaagttcggaaattgaaaacatcgtaaccaccacggacaagctgtttcaatccctgcaaatggatacggaacggcaagaccctgccacgaaagaagccctgcaataccgcaccgccctgtttgcaggctatgaatcactggcgagccgccctttatgcacacaaaccgccatcatggtctgcaacgccatcaagcacccctacgaaacggccatccgcaaaacaggcggcacagccctaaaaggaggtaacagcggaaatgttgtctataccccgcccgaaggagaagaaaccatacgcggcaagctggcaaattgggagcggtttattcacgaaagcggcgatttagacccgcttgtcatcatggcggcggcacattaccaatttgaagccatccacccgtttacggacggcaacgggcggacgggacgcatattgaacagcctgctattgattgaaaaagggcttttggatttgcctattttgtatttgagccgctacatcatcgaaaacagggcggactattaccgcctgcttttaggcgtaaccgaacggcaggattgggaaagctggataatctacatcttagacggcgtagccgacaccgccgattggacggtatcgaaaatagatgcgatacgctgcctgttcgagcagacacgtcaacacatacggacacacgcacaaggaatctacacgcacgaactggtaaatcttctgtttgagcagccatatacacgcattgccaacctagaagcggcagggatagccaaacggcagacggcctctaagtacctgaaagagctttcaggcataggtgtgctgcaagaaatcgccatcggcagggacaaactattcattcatccgcgcctaatggaactattgcggggagagggcaacagctttacttcattc

SEQ ID NO: 7206 - protein, 369 aa, Neisseria gonorrhoeae
MSNWKPDIPYNDLPPLPPKQDIESKTILKRCIAARASLARLKQAAELIPNQAMLINTLPVMEARASSEIENIVTTTDKLFQSLQMDTERQDPATKEALQYRTALFAGYESLASRPLCTQTAIMVCNAIKHPYETAIRKTGGTALKGGNSGNVVYTPPEGEETIRGKLANWERFIHESGDLDPLVIMAAAHYQFEAIHPFTDGNGRTGRILNSLLLIEKGLLDLPILYLSRYIIENRADYYRLLLGVTERQDWESWIIYILDGVADTADWTVSKIDAIRCLFEQTRQHIRTHAQGIYTHELVNLLFEQPYTRIANLEAAGIAKRQTASKYLKELSGIGVLQEIAIGRDKLFIHPRLMELLRGEGNSFTSF

SEQ ID NO: 7207 - DNA, 108 bp, Neisseria gonorrhoeae
atggctaaaataaaatgtttaataaacaaaatgttgaaacttaatttcgatagagcctctgcatatcgtattgaggcgttaatggaatttgagaaagctatttttaaa

SEQ ID NO: 7208 - protein, 36 aa, Neisseria gonorrhoeae
MAKIKCLINKMLKLNFDRASAYRIEALMEFEKAIFK

SEQ ID NO: 7209 - DNA, 648 bp, Neisseria gonorrhoeae
ggcttttccggtgttttcgagatttccctcaacgcctgattgagcgcgcccaaatccaacgccgtttccgaacggcaggcatcgccgaagatgttttttatattccgccgtcagtttcagtatccctttgaacgcgcgcccttccaaagccgccgacaactcgaaaatatcggcgaacacgcgcccataggtttcgcccgaggcgaccgcgtccgtccccaatgcgaacatatccatttttgccaactcggcggcaatcgtgcgcgcgtcttcgtcgtcgggcagcacttccgccttgaacctgacctgttccgccatgcctttgccgtggtttttgaccagcagggcgagcatttgcggcttgtgttccaagtgttgcaaagaagcgtgcaggacggggtgtatgctttcgttctgtatcattttttcgcggtagaacttttctgccttagcctttgaacgcaccgacacgaacgcccacgccagccacaccagcgcgacggcggacaatgcggacagaagcggaggcagctcttcagtataggctttctgattgaaccagatttgcgcggtcaaaaaaccggcaaagaaaatcaaaacataaagtatcggtgcgaaacgactttggacagaagcgtgcatcatcat

SEQ ID NO: 7210 - protein, 12 aa, Neisseria gonorrhoeae
GFSGVFEISLNA

SEQ ID NO: 7211 - DNA, 159 bp, Neisseria gonorrhoeae
atgccgcctgaaaggcttcagacggcattttttacacaattcccaccgtttcccatcatccccgacaataccgtaatcttgaaatccgtcattcccgcgcaggcgggaatccggaccgttcggtttcggtttttttttggctgtgttttaacgatgtgt

SEQ ID NO: 7212 - protein, 53 aa, Neisseria gonorrhoeae
MPPERLQTAFFTQFPPFPIIPDNTVILKSVIPAQAGIRTVRFRFFFGCVLTMC

SEQ ID NO: 7213 - DNA, 297 bp, Neisseria gonorrhoeae
gtggttccggtatttgaggctttgattagggatgcggactttcaatatatttttctcagttacaacaacgaagtcttgatgtctgtcgggcaggtaagggagatttttgagtgtttcggcaaatataatttggttcaaacggaataccggcattttaaggcggataagacagaaaaccgtaatcataaggcaaattcgacattcgaatatctgcatattttagaaaagaccttttatagtggattaacaaaaaccggtacggcgttgcctcgccttagctcaaagagaacgattctc

SEQ ID NO: 7214 - protein, 99 aa, Neisseria gonorrhoeae
VVPVFEALIRDADFQYIFLSYNNEVLMSVGQVREIFECFGKYNLVQTEYRHFKADKTENRNHKANSTFEYLHILEKTFYSGLTKTGTALPRLSSKRTIL

SEQ ID NO: 7215 - DNA, 141 bp, Neisseria gonorrhoeae
atgccgtctgaagcctttcaggcggcatttgcggcattcggacatttaaaaatcccgtcattcccgcgcaggagggaatccgaatacatccgcacagaaacctgcatcccgtcattcccgcgaaagcgggaatctagaacg

SEQ ID NO: 7216 - protein, 47 aa, Neisseria gonorrhoeae
MPSEAFQAAFAAFGHLKIPSFPRRRESEYIRTETCIPSFPRKRESRT

SEQ ID NO: 7217 - DNA, 168 bp, Neisseria gonorrhoeae; identical to SEQ ID NO: 4713

SEQ ID NO: 7218 - protein, 56 aa, Neisseria gonorrhoeae; identical to SEQ ID NO: 4714

SEQ ID NO: 7219 - DNA, 354 bp, Neisseria gonorrhoeae
ggcttccgccaccgaatcccggttgtaggttttttcgcagtagtggcatttcagccgcgtctgcccgttgtgtttcttaacataaaaccggcttttgaccggctcgccgtggccggcgcaattgggattcgggcagcggaacacttcggcgatttcgtcgggcagggtcaaatgccgcttctgtacgaccttgaaattgtcgatggtgttgaccaccgcttcgggggcgaacagggcgaggcggtcggcggctttatcgtccaagcacacgcctttgattttgatgatgtctttgctgccctgggttttgctgggcaggttgaagcccacggttaccgcgttgccgtagtgcaa

SEQ ID NO: 7220 - protein, 118 aa, Neisseria gonorrhoeae
GFRHRIPVVGFFAVVAFQPRLPVVFLNIKPAFDRLAVAGAIGIRAAEHFGDFVGQGQMPLLYDLEIVDGVDHRFGGEQGEAVGGFIVQAHAFDFDDVFAALGFAGQVEAHGYRVAVVQ

SEQ ID NO: 7221 - DNA, 918 bp, Neisseria gonorrhoeae
cacttcttcgttcaacaccagcgacaatatcgccatacgcgcataaacgccgttggtcgcctgctcgaaataataggcgtgcggcgcggcatcgacatcggggtggatttcgtccgtgcgcggcagggggtgcagcacgcgcaggttcggtttggcgcgggcgagcatagacgcttcgaggttgaatttgccttggattttggcaaattcctgttcgtcgaaacgttcgcgctggacgcgggtcatatacaggatgtccgcccattccgccgcctcttccaaactgccgagggcgcggtatcggcagtcggcttcttccaactcttcggtaatgtagtcgggcatcgcgaggctgggcggcgagacgaaggcaaattcgcagccccagcgtttcaacgcctgacacagcgaatgcacggtgcgcccgtatttcaagtcgcccgccatggcgattttaagcttgtccaaacgcccctgcgtttcataaatcgttaccaggtccaacaaggtttggctggggtgttggttcgtgccgtcgccggcgttgatgacggggacgcgcgaaaactccgccgccacgcgcgccgcgccgtctttgggatggcgttggacaatcgcgtcggtgtagccggaaatgatacgggcggtatcggcaagcgtttcgccttttttggcactggtattcgcgccgtccgaaaagccgatgaccttaccgcccaaacgctgcaccgccgtttcaaacgacagcctcgtgcgcgtggacggctcgaaaaagcacgaaccgatgagtttgccttccaacaaatcgccgcgcggatgcgccttcagcttcaatgccgtctgaagcaggtattccaactgttcgcgcgacaaatccgaaatggagatgatgtgctgtctgtaaagcggattaggcat

SEQ ID NO: 7222 - protein, 306 aa, Neisseria gonorrhoeae
HFFVQHQRQYRHTRINAVGRLLEIIGVRRGIDIGVDFVRARQGVQHAQVRFGAGEHRRFEVEFALDFGKFLFVETFALDAGHIQDVRPFRRLFQTAEGAVSAVGFFQLFGNVVGHREAGRRDEGKFAAPAFQRLTQRMHGAPVFQVARHGDFKLVQTPLRFINRYQVQQGLAGVLVRAVAGVDDGDARKLRRHARRAVFGMALDNRVGVAGNDTGGIGKRFAFFGTGIRAVRKADDLTAQTLHRRFKRQPRARGRLEKARTDEFAFQQIAARMRLQLQCRLKQVFQLFARQIRNGDDVLSVKRIRH

SEQ ID NO: 7223 - DNA, 978 bp, Neisseria gonorrhoeae
gtggcggatcggaggggcaggcggtcggcaaaccgtgcgcccggcggcggcattgccgtacattataacagccaaatacgcatcctgctttcagacggcatggctgtcaagaaaaagcggcgcgtgtacaatatgcggattgtatgtttaggacggattggaaaaaggatggaaaatatcggcaggcagcggcccatcggcgtttttgactcgggaatcggcggtttgaccaatgtgcgcgcgctgatggaacggctgccgatggagaacatcatttatttcggcgacacggcgcgcgtgccttacgggacgaaatctaaggcgaccatcgaaaatttctcgatgcagattgtcgattttttattgggacacgatgtcaaggcgatggttatcgcgtgcaacacgattgcggcggttgcggggcggaaaatccgtcaaaagacgggcaatatgcccgttttggacgtgatttccgccggcgccaaagccgcgctggcaacgacgcgcaacaataaaatcggcatcatcgccaccaatacgacagtcaacagcaatgcttatgcgcgcgccatccacagggacaaccccgacacgctcgtccgcacgcaggccgcgccgctgctcgtccctttggtggaggaaggttggttggaacacgaagttacccgcctgaccgtatgcgaatacctcaaaccattgcttgcagacggcatcgatacgctggtgttgggctgcacgcactttcccttgctcaagcccttaatcggcagggaggcgcacaatgtcgcgctggtcgattccgcgattacgacggccgaagaaaccgcacgcgtccttgcacaggaaggattgctcgataccggcaacaacaatcccgactaccgtttttacgtcagcgatattcctttgaaattcagaaccatcggcgagcgttttctgggcaggacgatggagcagattgaaatggtgtctttgggt

SEQ ID NO: 7224 - protein, 326 aa, Neisseria gonorrhoeae
VADRRGRRSANRAPGGGIAVHYNSQIRILLSDGMAVKKKRRVYNMRIVCLGRIGKRMENIGRQRPIGVFDSGIGGLTNVRALMERLPMENIIYFGDTARVPYGTKSKATIENFSMQIVDFLLGHDVKAMVIACNTIAAVAGRKIRQKTGNMPVLDVISAGAKAALATTRNNKIGIIATNTTVNSNAYARAIHRDNPDTLVRTQAAPLLVPLVEEGWLEHEVTRLTVCEYLKPLLADGIDTLVLGCTHFPLLKPLIGREAHNVALVDSAITTAEETARVLAQEGLLDTGNNNPDYRFYVSDIPLKFRTIGERFLGRTMEQIEMVSLG

SEQ ID NO: 7225 - DNA, 1410 bp, Neisseria gonorrhoeae
atggtcgataaccgtgcctttttcgatggcttcgacactgagtttttgcgcttccatatcggttcctcacacttcttcgttcaacaccagcgacaatatcgccatacgcgcataaacgccgttggtcgcctgctcgaaataataggcgtgcggcgcggcatcgacatcggggtggatttcgtccgtgcgcggcagggggtgcagcacgcgcaggttcggtttggcgcgggcgagcatagacgcttcgaggttgaatttgccttggattttggcaaattcctgttcgtcgaaacgttcgcgctggacgcgggtcatatacaggatgtccgcccattccgccgcctcttccaaactgccgagggcgcggtatcggcagtcggcttcttccaactcttcggtaatgtagtcgggcatcgcgaggctgggcggcgagacgaaggcaaattcgcagccccagcgtttcaacgcctgacacagcgaatgcacggtgcgcccgtatttcaagtcgcccgccatggcgattttaagcttgtccaaacgcccctgcgtttcataaatcgttaccaggtccaacaaggtttggctggggtgttggttcgtgccgtcgccggcgttgatgacggggacgcgcgaaaactccgccgccacgcgcgccgcgccgtctttgggatggcgttggacaatcgcgtcggtgtagccggaaatgatacgggcggtatcggcaagcgtttcgccttttttggcactggtattcgcgccgtccgaaaagccgatgaccttaccgcccaaacgctgcaccgccgtttcaaacgacagcctcgtgcgcgtggacggctcgaaaaagcacgaaccgatgagtttgccttccaacaaatcgccgcgcggatgcgccttcagcttcaatgccgtctgaagcaggtattccaactgttcgcgcgacaaatccgaaatggagatgatgtgctgtctgtaaagcggattaggcatttttgccccccttccgtaaaaaacccgcgtcaggcgggtatccggttatacgtccacgccgcccgtatgtttgcggaacagcttcgcaaaagcggcgacacggcgcgtattatcgcacatttgcctccacaaagttttaccgcacgaatcctgtatttttcagacggcatatccaaacacgcccgcataagcataaggtataatcgcgccagacatttcttttcaggaagccgccatgttaatctgcaacccctacgaagtcgtcatccacggcacaacgagttccggcaagattttccgccccggcgactgggcggaacgcctgtgcggcatcctgtcctcgttcaccaaagacaaccgcctctcctattcgaaatgggtgcgccccatgctggtggacaacatccgctgcgtcgccgtcga

SEQ ID NO: 7226 - protein, 470 aa, Neisseria gonorrhoeae
MVDNRAFFDGFDTEFLRFHIGSSHFFVQHQRQYRHTRINAVGRLLEIIGVRRGIDIGVDFVRARQGVQHAQVRFGAGEHRRFEVEFALDFGKFLFVETFALDAGHIQDVRPFRRLFQTAEGAVSAVGFFQLFGNVVGHREAGRRDEGKFAAPAFQRLTQRMHGAPVFQVARHGDFKLVQTPLRFINRYQVQQGLAGVLVRAVAGVDDGDARKLRRHARRAVFGMALDNRVGVAGNDTGGIGKRFAFFGTGIRAVRKADDLTAQTLHRRFKRQPRARGRLEKARTDEFAFQQIAARMRLQLQCRLKQVFQLFARQIRNGDDVLSVKRIRHFCPPSVKNPRQAGIRLYVHAARMFAEQLRKSGDTARIIAHLPPQSFTARILYFSDGISKHARISIRYNRARHFFSGSRHVNLQPLRSRHPRHNEFRQDFPPRRLGGTPVRHPVLVHQRQPPLLFEMGAPHAGGQHPLRRRR

SEQ ID NO: 7227 - DNA, 510 bp, Neisseria gonorrhoeae
ttgccgaccgcctgcccctccgatccgccacataaaagttgtaaagcccctatgtctgatttttcccccgtttcccgattccttgccgacgaagccgccacactcgatttgggcgcggcgtggtcttcccgtttaaacgcaccgctggtcatttacctcgaaggggatttgggtgcgggcaaaaccacgctgacgcgcggcatcctgcgcggattgggtcaccagggcgcagtcaaaagcccgacctacgccatcgtcgaatcttatccgctggaacgcttcgccctgcaccatttcgacctctaccgcttctcgttccccgaagaatgggaagacgcggggcttgacgagctgtttgccgcaaacagcgtctgcctgatcgaatggccgcaacagggaggcgaatttaccccgcctgccgacatcaccgcaacattgacacacggcggcggcggcagaaaatgcctgctgaccgcccataccgaacgaggacgcgaaagcctgccgcta

SEQ ID NO: 7228 - protein, 170 aa, Neisseria gonorrhoeae
LPTACPSDPPHKSCKAPMSDFSPVSRFLADEAATLDLGAAWSSRLNAPLVIYLEGDLGAGKTTLTRGILRGLGHQGAVKSPTYAIVESYPLERFALHHFDLYRFSFPEEWEDAGLDELFAANSVCLIEWPQQGGEFTPPADITATLTHGGGGRKCLLTAHTERGRESLPL

SEQ ID NO: 7229 - DNA, 2106 bp, Neisseria gonorrhoeae
gtggcggtcattgtgcggtggtgcgggtcaaaagggcgtattttatcagaattgtatgccgcgcccgtttcggatggtgcgcggtgttttgttataatacggcggcgtatgccgtttcagacggcatttttctgtattttcctgttcggacggtccatgaacgaattttcgcttgcccctattgtggttgttctgctggtgtcggtcattacggtgatcctgtgccgcaagttcaacattccctccatgctgggctacctgctggtgggctttttggcggggcccggtatgctcagcctgattccgaaaagccatgcgacggattatttgggcgaaatcgggattgtgttcctgatgttcagcatcggtttggagttttcattgcccaagctgagggcgatgaggcggctggtgttcggtctgggcggtttgcaggtcggcgttacgatgctgtcggtaatgggcatactgatgctgacgggcgtgccgttcaattgggcgtttgccgtatcgggcgcgttggcgatgtcgtccacggcgattgtgagccggattttgtcggaaaagacggagttggggcagccgcacggtcagatggcgatgggcgtgctgctgatgcaggacatcgccgtcgtgccgctgatgattctgattcccgcgctggctggcggaggggacggaaatatttgggcggccttgggtttggcgtttgcaaaaatgctgctgacgctggggctgctgtttttcgtcggcagcaaaattatgtcgcgatggttcaggatggtggcaaaacgcaaatcgtccgaactctttatgatcaatgtgctgctggtaaccttgggtgtggcttatctgactgagctggaaggtttgtctatggcgttgggcgcattcgttgccggcatgttgctttcggaaacggaataccgtttccaagtcgaagacgacattcgcccgttccgcgatattttgctcggcttcttctttatcacggtcggcatgaagctggacattcaggcattgatcggcggctggcggcaggtattgatgctgttggcaatgctgctggtgttgaaggcattggttgtgtttgccattgcattcaaaatgaagcattcggtcggcgacagcctcaaaacggctttgtatctcgcgcaaggcggcgagttcggcttcgtgatgctggccattgccgggcagcttgatatggtttcgccagaattggaacaggcggcgacggcggcggttctgctgtcgatgattatcgcgcccttcctcttgggcggcagcgatgcgctggtcgggcgcttggtcaagtcaagctgggacatgaagtcgctcgatctgcacagcatgttggtggaagcgatgagcaagtctgatcatgtgctgattgtcggcttcggcaggggcgggcagacggtcggacgcgtcctcgcccaagaggatattccgtatttcgcgctcgacttggacatcgcacgcgtgcaggtagccagaagtgcaggcgagccggtgtcgttcggcgatgcgaaacgcagggaagtattggaagccgccggtctgggacgggcgaaaatggtggtggttacgctcaacaatatgcacgaaacgcaacacgttttagacaatgtgctgtccatgcatcccaatatgcccgtatatgcgcgcgccaccaatgacgattatgtgaaaacgtttaccgatatgggtgcggaagaagccgtgtcggacaccaaagaaaccggactcgtgctggcaggctatgcgatgttgggtaacggcgcgtcgtaccggcacgtctatcagacgatggcaaatatccgccacagccgttatgccgcgttggagggactgtttgtcggtagtgatgatgaggcaggattcggcgaaaatggcgaaaccgtccgccacgcctttcctttggctgcagaagcatacgccgtcggcaaaacagtcggcacgcttccgatggcggcttacggcatcaaactcttgttcgtccgccgccgcaccggccggattgaaaacccggatgcctcgtttacattggaaggcggtgacgtgttggtggtcgcaggcaaaaaaaaaagaaattatctcttt

SEQ ID NO: 7230 - protein, 702 aa, Neisseria gonorrhoeae
VAVIVRWCGSKGRILSELYAAPVSDGARCFVIIRRRMPFQTAFFCIFLFGRSMNEFSLAPIVVVLLVSVITVILCRKFNIPSMLGYLLVGFLAGPGMLSLIPKSHATDYLGEIGIVFLMFSIGLEFSLPKLRAMRRLVFGLGGLQVGVTMLSVMGILMLTGVPFNWAFAVSGALAMSSTAIVSRILSEKTELGQPHGQMAMGVLLMQDIAVVPLMILIPALAGGGDGNIWAALGLAFAKMLLTLGLLFFVGSKIMSRWFRMVAKRKSSELFMINVLLVTLGVAYLTELEGLSMALGAFVAGMLLSETEYRFQVEDDIRPFRDILLGFFFITVGMKLDIQALIGGWRQVLMLLAMLLVLKALVVFAIAFKMKHSVGDSLKTALYLAQGGEFGFVMLAIAGQLDMVSPELEQAATAAVLLSMIIAPFLLGGSDALVGRLVKSSWDMKSLDLHSMLVEAMSKSDHVLIVGFGRGGQTVGRVLAQEDIPYFALDLDIARVQVARSAGEPVSFGDAKRREVLEAAGLGRAKMVVVTLNNMHETQHVLDNVLSMHPNMPVYARATNDDYVKTFTDMGAEEAVSDTKETGLVLAGYAMLGNGASYRHVYQTMANIRHSRYAALEGLFVGSDDEAGFGENGETVRHAFPLAAEAYAVGKTVGTLPMAAYGIKLLFVRRRTGRIENPDASFTLEGGDVLVVAGKKKRNYLF

SEQ ID NO: 7231 - DNA, 840 bp, Neisseria gonorrhoeae
atgttaatctgcaacccctacgaagtcgtcatccacggcacaacgagttccggcaagattttccgccccggcgactgggcggaacgcctgtgcggcatcctgtcctcgttcaccaaagacaaccgcctctcctattcgaaatgggtgcgccccatgctggtggacaacatccgctgcgtcgccgtcgataaaaaactggaaaccgacaatccgcagatgttccgcttcctgatggactttgccgccgacaacgacctgcgcgtcatcgactgcaaagccctgctcgaagaacgcgaacagggcggacaaaacgaccctgccaacgaacgcgtcctgctggcacaggcaatcgaagaaaaacacgccgccgagaaaacacaggaacagaccgcctcgggcgcatcctacgttttacgcgaaatcggcgcggacgacaccgccaccgcctttgcagccttgagcgttttgcgttcctccctgaccgacatcggccgctttaccgaacagatcaacaaaatccaacgcccccaaggctaccgcctgctgggtatttttgaagaatgcaaacacaacgccgtcgccgtctgcggcttccgcgaagcctgcaccctcgccggcggccgccacatccacatcgacgacatcgttaccctgccgcaaagccgccgcaaaggctacgcctcgcgccttttggaagaagtccgcaaaatcggcgcggaaacaggggttaccaaaatccaccttaacgtccacgtcaaccacgaccgtaccgacgcgcaccgcctgtatttcaaaaacggttttgaaatctgcgcctaccacttccgttgcgaccccaaa

SEQ ID NO: 7232 - protein, 280 aa, Neisseria gonorrhoeae
MLICNPYEVVIHGTTSSGKIFRPGDWAERLCGILSSFTKDNRLSYSKWVRPMLVDNIRCVAVDKKLETDNPQMFRFLMDFAADNDLRVIDCKALLEEREQGGQNDPANERVLLAQAIEEKHAAEKTQEQTASGASYVLREIGADDTATAFAALSVLRSSLTDIGRFTEQINKIQRPQGYRLLGIFEECKHNAVAVCGFREACTLAGGRHIHIDDIVTLPQSRRKGYASRLLEEVRKIGAETGVTKIHLNVHVNHDRTDAHRLYFKNGFEICAYHFRCDPK

SEQ ID NO: 7233 - DNA, 1296 bp, Neisseria gonorrhoeae
atgcctgctgaccgcccataccgaacgaggacgcgaaagcctgccgctatgaccaaactgacacgaagacaaatcatccgccgcaccgccggcacactgttcgccctgagccccatcgcatccgccgttgccaaaacggtacgcgccccgcagtttaccgccgcacggatatggccgtcgcacacctacacccgcctgacgctggaaagcaccgccgcgctcaaataccagcacttcgcgctcgacaacccgggcaggttggtcgtcgatatacaaaacgcaaacatcaataccgtattgcacgggctttcccaaaaagttatggcggacgacccctttatccgcagcatacgcgcgggtcagaacacgccgaccaccgtccgcctcgtcatcgacctgaaacagcccacccacgcacaagtcttcgcgcttccgcccgtcggcggctttaaggaccgcctcgtcgtcgacctctatccgcacgggatggatgccgacgatccgatgatggcgctgctcaacggcagcctgaacaaaaccctgcgcggctctccggaagccgaccccgcccaaaacaccacgccccgacccgggcggggcaaaaacgggcgcagacccgtcatcatgctcgatccgggacacggcggtgaagaccccggcgccgtcagcccgggcggtttgcaggaaaaacacgtcgtcctctccatcgcccgcgaaaccaaaaaacaattggaagccttgggttacaacgtctttatgacgcgcaacgaagacgtgttcatcccattgggcgtgcgtgtcgccaaagggcgcgcacggcgggcggacgtattcgtctccatccacgccgacgctttcaccagcccctccgcgcgcggaacgggggtttatatgctgaacaccaaaggcgcgaccagctctgccgccaaattcttggaacaaacccaaaataatgccgacgcggtcggcggcgtaccgaccagcggcaaccgcaacgtcgataccgccctgctcgacatgacgcaaaccgccacactgcgcgacagccgcaaactcggcaaactggtgcttgaagaattgggcaggctcaaccatctgcacaaaggcagggtggacgaagccaatttcgccgtattgcgcgcacccgatatgccgtctatcctggtcgaaaccgccttcctgtccaatcctgccgaagagaaactgctgggcagcgaatccttccgtcggcagtgcgcccaatccattgcctcgggtgtccaacgctacatcaatacatccgtattgaagcggggt

SEQ ID NO: 7234 - protein, 432 aa, Neisseria gonorrhoeae
MPADRPYRTRTRKPAAMTKLTRRQIIRRTAGTLFALSPIASAVAKTVRAPQFTAARIWPSHTYTRLTLESTAALKYQHFALDNPGRLVVDIQNANINTVLHGLSQKVMADDPFIRSIRAGQNTPTTVRLVIDLKQPTHAQVFALPPVGGFKDRLVVDLYPHGMDADDPMMALLNGSLNKTLRGSPEADPAQNTTPRPGRGKNGRRPVIMLDPGHGGEDPGAVSPGGLQEKHVVLSIARETKKQLEALGYNVFMTRNEDVFIPLGVRVAKGRARRADVFVSIHADAFTSPSARGTGVYMLNTKGATSSAAKFLEQTQNNADAVGGVPTSGNRNVDTALLDMTQTATLRDSRKLGKLVLEELGRLNHLHKGRVDEANFAVLRAPDMPSILVETAFLSNPAEEKLLGSESFRRQCAQSIASGVQRYINTSVLKRG

SEQ ID NO: 7235 - DNA, 837 bp, Neisseria gonorrhoeae; identical to SEQ ID NO: 4761

SEQ ID NO: 7236 - protein, 279 aa, Neisseria gonorrhoeae; identical to SEQ ID NO: 4762

SEQ ID NO: 7237 - DNA, 1566 bp, Neisseria gonorrhoeae
ttggtatctcaatttatccatacctttcatcataaaaacgcggtttggggcggaagtaggtttatgcctgccttcatccgacaactatattttgaaacaccgccttttcaatcaaccccgcttcaatacggatgtattgatgtagcgttggacacccgaggcaatggattgggcgcactgccgacggaaggattcgctgcccagcagtttctcttcggcaggattggacaggaaggcggtttcgaccaggatagacggcatatcgggtgcgcgcaatacggcgaaattggcttcgtccaccctgcctttgtgcagatggttgagcctgcccaattcttcaagcaccagtttgccgagtttgcggctgtcgcgcagtgtggcggtttgcgtcatgtcgagcagggcggtatcgacgttgcggttgccgctggtcggtacgccgccgaccgcgtcggcattattttgggtttgttccaagaatttggcggcagagctggtcgcgcctttggtgttcagcatataaacccccgttccgcgcgcggaggggctggtgaaagcgtcggcgtggatggagacgaatacgtccgcccgccgtgcgcgccctttggcgacacgcacgcccaatgggatgaacacgtcttcgttgcgcgtcataaagacgttgtaacccaaggcttccaattgttttttggtttcgcgggcgatggagaggacgacgtgtttttcctgcaaaccgcccgggctgacggcgccggggtcttcaccgccgtgtcccggatcgagcatgatgacgggtctgcgcccgtttttgccccgcccgggtcggggcgtggtgttttgggcggggtcggcttccggagagccgcgcagggttttgttcaggctgccgttgagcagcgccatcatcggatcgtcggcatccatcccgtgcggatagaggtcgacgacgaggcggtccttaaagccgccgacgggcggaagcgcgaagacttgtgcgtgggtgggctgtttcaggtcgatgacgaggcggacggtggtcggcgtgttctgacccgcgcgtatgctgcggataaaggggtcgtccgccataactttttgggaaagcccgtgcaatacggtattgatgtttgcgttttgtatatcgacgaccaacctgcccgggttgtcgagcgcgaagtgctggtatttgagcgcggcggtgctttccagcgtcaggcgggtgtaggtgtgcgacggccatatccgtgcggcggtaaactgcggggcgcgtaccgttttggcaacggcggatgcgatggggctcagggcgaacagtgtgccggcggtgcggcggatgatttgtcttcgtgtcagtttggtcatagcggcaggctttcgcgtcctcgttcggtatgggcggtcagcaggcattttctgccgccgccgccgtgtgtcaatgttgcggtgatgtcggcaggcggggtaaattcgcctccctgttgcggccattcgatcaggcagacgctgtttgcggcaaacagctcgtcaagccccgcgtcttcccattcttcggggaacgagaagcgg

SEQ ID NO: 7238 - protein, 522 aa, Neisseria gonorrhoeae
LVSQFIHTFHHKNAVWGGSRFMPAFIRQLYFETPPFQSTPLQYGCIDVALDTRGNGLGALPTEGFAAQQFLFGRIGQEGGFDQDRRHIGCAQYGEIGFVHPAFVQMVEPAQFFKHQFAEFAAVAQCGGLRHVEQGGIDVAVAAGRYAADRVGIILGLFQEFGGRAGRAFGVQHINPRSARGGAGESVGVDGDEYVRPPCAPFGDTHAQWDEHVFVARHKDVVTQGFQLFFGFAGDGEDDVFFLQTARADGAGVFTAVSRIEHDDGSAPVFAPPGSGRGVLGGVGFRRAAQGFVQAAVEQRHHRIVGIHPVRIEVDDEAVLKAADGRKREDLCVGGLFQVDDEADGGRRVLTRAYAADKGVVRHNFLGKPVQYGIDVCVLYIDDQPARVVEREVLVFERGGAFQRQAGVGVRRPYPCGGKLRGAYRFGNGGCDGAQGEQCAGGAADDLSSCQFGHSGRLSRPRSVWAVSRHFLPPPPCVNVAVMSAGGVNSPPCCGHSIRQTLFAANSSSSPASSHSSGNEKR

SEQ ID NO: 7239 - DNA, 234 bp, Neisseria gonorrhoeae
atgattatgggtgtattaattttttttctaatcgttccaattttgggatttatttgcgctacgataaattattttattattaataaatttaaacttccaaaatacatggcgtatttactcccatcattatctattttattcatatttattcatgcaataaaattgcatatgattttatttttttatgtttcatgcgtttattccgcgtatacatattatgataaaaaatcttta

SEQ ID NO: 7240 - protein, 78 aa, Neisseria gonorrhoeae
MIMGVLIFFLIVPILGFICATINYFIINKFKLPKYMAYLLPSLSILFIFIHAIKLHMILFFYVSCVYSAYTYYDKKSL

SEQ ID NO: 7241 - DNA, 876 bp, Neisseria gonorrhoeae; identical to SEQ ID NO: 3893

SEQ ID NO: 7242 - protein, 292 aa, Neisseria gonorrhoeae; identical to SEQ ID NO: 3894

SEQ ID NO: 7243 - DNA, 96 bp, Neisseria gonorrhoeae
gtgcgcggcttcggcttttcagacggcatatttgacgttatgattaaacagttaacaagatttatcacaacgccgtcaaaagacagacacacaaca

SEQ ID NO: 7244 - protein, 32 aa, Neisseria gonorrhoeae
VRGFGFSDGIFDVMIKQLTRFITTPSKDRHTT

SEQ ID NO: 7245 - DNA, 267 bp, Neisseria gonorrhoeae
ttgaatgtgtgccaagtctacaaaggagaagtagaggagaaaaatcaagctgcatcaagcaactcaacggcggtaattatccgccgtttcttatctgctgtcaattattttttgaaaatttacccgaccgattcaaattttgcaaaaaacttgcccgatggctatccggtaacaaattccctcaaaaacccgtcaatccgattattcaaaaaatcatatgctttcatcgtgtttccttttcggttgaaaccctgccctttagggcgg

SEQ ID NO: 7246 - protein, 89 aa, Neisseria gonorrhoeae
LNVCQVYKGEVEEKNQAASSNSTAVIIRRFLSAVNYFLKIYPTDSNFAKNLPDGYPVTNSLKNPSIRLFKKSYAFIVFPFRLKPCPLGR

SEQ ID NO: 7247 - DNA, 129 bp, Neisseria gonorrhoeae
atgtttgttgacccccgcttcttaccaaaacatccatgtacggagttggaaagcacggcgagattccggcatagtaaaacaagatttggatttttcttgcggcgcggcttcgattgccacgttactgaa

SEQ ID NO: 7248 - protein, 43 aa, Neisseria gonorrhoeae
MFVDPRFLPKHPCTELESTARFRHSKTRFGFFLRRGFDCHVTE

SEQ ID NO: 7249 - DNA, 870 bp, Neisseria gonorrhoeae; identical to SEQ ID NO: 307

SEQ ID NO: 7250 - protein, 290 aa, Neisseria gonorrhoeae; identical to SEQ ID NO: 308

SEQ ID NO: 7251 - DNA, 105 bp, Neisseria gonorrhoeae
atgccgtctgaagccgcttcagacggcattttatcaagctctccgtccgccgtacccgtgccgtccgtatcttaccgcccacccttccggccgtgccgttttcaa

SEQ ID NO: 7252 - protein, 35 aa, Neisseria gonorrhoeae
MPSEAASDGILSSSPSAVPVPSVSYRPPFRPCRFQ

SEQ ID NO: 7253 - DNA, 588 bp, Neisseria gonorrhoeae
ttgcttggcctatgtttgttgacccccgcttcttaccaaaacatccatgtacggagttggaaagcacggcgagattccggcatagtaaaacaagatttggatttttcttgcggcgcggcttcgattgccacgttactgaataatttttatggcagacattattctgaagcggaaatcttagacaaaatggataaaacccaaatgcgtacttcttttgatgatatgcaacgcataatgcccgaactgggttttgaagcacaaggttatgctttgccatttgaacagttggtacaactaaaaattcctgtaattgtgtatttaaaataccgtaaaaacaaccatttttcggtattgaacggtattaacggagaaactgttttgctggctgatccatcgctggggcacgtctcaacgagcaaatcacaattcttgagcgcatggaaaacacgtgatggcgaaatggaaggaaaaattttagccatcgtgccaaaaaatactgattttgttagaaatcagatgttttttaataaaaatcccgttcgtcaaacacgttttacggtagaacaaatccaaatgcggcaaaaacga

SEQ ID NO: 7254 - protein, 196 aa, Neisseria gonorrhoeae
LLGLCLLTPASYQNIHVRSWKARRDSGIVKQDLDFSCGAASIATLLNNFYGRHYSEAEILDKMDKTQMRTSFDDMQRIMPELGFEAQGYALPFEQLVQLKIPVIVYLKYRKNNHFSVLNGINGETVLLADPSLGHVSTSKSQFLSAWKTRDGEMEGKILAIVPKNTDFVRNQMFFNKNPVRQTRFTVEQIQMRQKR

SEQ ID NO: 7255 - DNA, 1029 bp, Neisseria gonorrhoeae; identical to SEQ ID NO: 4823

SEQ ID NO: 7256 - protein, 343 aa, Neisseria gonorrhoeae; identical to SEQ ID NO: 4824

SEQ ID NO: 7257 - DNA, 1140 bp, Neisseria gonorrhoeae
atgaatactttatatacacttttcgccacctgcccgcgcggcttggaaaccgttttatctcaagaactcggaagcctcggctgtaccgatgtccaagcgtttgacggcggcgtttcctgccggggcggattggaacaggcctacgccgccaacctgcactcgcgtaccgccggccgcatcctgctgcgcctgaccaaaggcacataccgcaccgagcgcgacatctacaaacttgccaaaaacatcaactggttcaactggtttaccttgcagcagacgttcaaagtcaaaatcgaggcaaaacgcgccaacgtcaaaagcctccaatttgccggcctgaccgtcaaagatgccgtctgcgacgctttccgcgacatttacgacgcacgtccgagcgtggacaaagccgcgcccgatgtccgcatccacgcctttttggacgaacgcaatgtcgaaatcttcatcgacacttcgggcgaagccctgttcaaacgcggctaccgcctggataccggcgaagccccgctgcgcgaaaaccttgccgccgggctgctgctctcggcaggctacgacggcacgcagccgtttcaagacccgttttgcggcagcggcacgattgctatcgaagccgcttggattgccgccggccgcgcgccgggtatgatgcgccgcttcggttttgaaaaactgcaaaatttcgataaaacgctgtgggcggatttgcgccgccgcgccgaagcgcaaacccgccccgtccgcgccccgattgcaggcagcgacaacggccgccgcatcgttcagacggcattggacaacgcacacaatgccggagcggacgacatcgtttccttcagcgttgccggcgcgcagtccgtccgtccgaacggcgaaaacggcatcatggtgtccaatccgccctacggcgtgcgccttgaggaagtccgcgctttgcaggcactttatccgcagttgggtacgtggttgaaaaaacactatgccggctggcgggtcggcatgtttaccggcgacagggaaatgcccaaattcatgcgcctgctgcccaagcggaaaatcccgctttataacggcaacatcgactgccgcctgttcctgatcgatatggtgcagggatcgaaccgt

SEQ ID NO: 7258 - protein, 380 aa, Neisseria gonorrhoeae
MNTLYTLFATCPRGLETVLSQELGSLGCTDVQAFDGGVSCRGGLEQAYAANLHSRTAGRILLRLTKGTYRTERDIYKLAKNINWFNWFTLQQTFKVKIEAKRANVKSLQFAGLTVKDAVCDAFRDIYDARPSVDKAAPDVRIHAFLDERNVEIFIDTSGEALFKRGYRLDTGEAPLRENLAAGLLLSAGYDGTQPFQDPFCGSGTIAIEAAWIAAGRAPGMMRRFGFEKLQNFDKTLWADLRRRAEAQTRPVRAPIAGSDNGRRIVQTALDNAHNAGADDIVSFSVAGAQSVRPNGENGIMVSNPPYGVRLEEVRALQALYPQLGTWLKKHYAGWRVGMFTGDREMPKFMRLLPKRKIPLYNGNIDCRLFLIDMVQGSNR

SEQ ID NO: 7259 - DNA, 1062 bp, Neisseria gonorrhoeae
ttgacggtttgttgcttatttgagcgggcgcacttcaagtccgaacatacggcgtgcggtgttcagcatttggcagctgaagccccattcgttgtcataccacgcgaacactttgaccatgttgccgtcgacgactttggtcagcgttgcgtcgaagtggctggcttcggtggtgtggttgaagtccatggaaaccaatggcagggtgttgtagcccaaaacgcctttgagcgcgcctgcttccgagacggctttcatcagtgcgttgatttcttcgactgtggtgtcgcgcgcggcttggaagctcaaatctaccaaggatacgttgacggtcggcacgcggatggcaagcccgtcgagtctgcctttcaattcgggcaagaccaaaccgacggcttttgccgcgccggttttggtcggaatcatgttttccacgccgctgcgggcgcggcgcaggtctttgtggcgcacgtcggtaacggtttggtcgttggtcagtgcgtggatggtggtcattgcgcctttgacgatgccgacgctttcgctcaacactttggcaaccggcgagaggcagttggtggtgcaggaagcgttggaaacgacggtcatgtcggcggtcaggacgctgtcgttcacgccgtacacgacggttgcatcgacatcgtcgccgcccggtgcggaaatgaggacttttttcgcgccgctttcgaggtggattttggctttttctttgctggtgaacgcgccggtgcattccatgaccaaatcgacaccgagttctttccacggcagttcggcagggttgcgggtcgagaagaaggggattttgtcgccgttgacgatgaggttgccgccgtcgtgggatacgtcggcttcaaagcgtccgtgtacggtgtcgaatttggtcagatgggcgttggtttcaaggctgccgctggcgttgacggcgacgatttggagttggtcttgaatctgatagtcgtagatggcgcgcaaaacctggcggccgatgcgtccgtagccgttgatggcgactttgatgcccatggtttgttcctttgt

SEQ ID NO: 7260 - protein, 354 aa, Neisseria gonorrhoeae
LTVCCLFERAHFKSEHTACGVQHLAAEAPFVVIPREHFDHVAVDDFGQRCVEVAGFGGVVEVHGNQWQGVVAQNAFERACFRDGFHQCVDFFDCGVARGLEAQIYQGYVDGRHADGKPVESAFQFGQDQTDGFCRAGFGRNHVFHAAAGAAQVFVAHVGNGLVVGQCVDGGHCAFDDADAFAQHFGNRREAVGGAGSVGNDGHVGGQDAVVHAVHDGCIDIVAARCGNEDFFRAAFEVDFGFFFAGERAGAFHDQIDTEFFPRQFGRVAGREEGDFVAVDDEVAAVVGYVGFKASVYGVEFGQMGVGFKAAAGVDGDDLELVLNLIVVDGAQNLAADASVAVDGDFDAHGLFLC

SEQ ID NO: 7261 - DNA, 156 bp, Neisseria gonorrhoeae; identical to SEQ ID NO: 4855

SEQ ID NO: 7262 - protein, 52 aa, Neisseria gonorrhoeae; identical to SEQ ID NO: 4856

SEQ ID NO: 7263 - DNA, 549 bp, Neisseria gonorrhoeae
tccgcccgccttgaccgcaccccctgcctttgccaccctgcccgatgccgtctgaagcctgaaccgccctaccagcccgatgatgcacgacaccgccggaaagggcatacacaaagccgtcagcacataacgcgcattccccgtattgaccacgtccgcgcccttcagcagcagcggcagcgcgttcgcccactcccacagcgaaggcgcgctgaacgccaataccgccaccagccccaacatccggaacaccccgatttccaagacctgccgccgccgcaccgaacggttgagcaaaaacacaaccgccaacccgaaacagaccaccgccgccataccgccgttggcgacaatctgcaaactgttgaacgcaatatcgggcgtaaccgccaacacgccttccgaatccggcacggcacgctgcaaatccaaaccctgcaacacattcaacacaaaaccgtagatcaaatcaaaaaacaccacgcctatcggcaaagcactcaaaacccgccacatcttcctatctgaccaaccgttcaaaaccttcat

SEQ ID NO: 7264 - protein, 175 aa, Neisseria gonorrhoeae
SARLDRTPCLCHPARCRLKPEPPYQPDDARHRRKGHTQSRQHITRIPRIDHVRALQQQRQRVRPLPQRRRAERQYRHQPQHPEHPDFQDLPPPHRTVEQKHNRQPETDHRRHTAVGDNLQTVERNIGRNRQHAFRIRHGTLQIQTLQHIQHKTVDQIKKHHAYRQSTQNPPHLPI

SEQ ID NO: 7265 - DNA, 723 bp, Neisseria gonorrhoeae
atgcgtattccgctgcttgcccctgacaattatgcctttcccgatcctgcctatgctttggcccggtgcgacgggctggtcggcgtgagcagggatttggacgcggggcggctgctcgaggcgtatcggaacggcgtgtttccttggttttcgcgggacggttggtttttttggtatgcggtcgggccgcgtgcggtaattgttcccgaacgtctgcacgttccgcgctcgctggcgaaaacgctgcgtaacggcagctatcgggttgcggtcaacggctgttttgcggaagttgtcgcgcattgtgcggcagcggcgcgcccgaatcaggatgggacttggattgcgcccgagtttcagacggcatatttgaagctgcacgaaatgggacacgcgcattctttcgagtgccattatcccgatgaaaacggtaaaacgaggttggcgggcggcttttacggcgttcagatcggcagggtgttttatggcgaatcgatgtttgcgttgcaaccggatgcgtcgaaaatcgcgtttgcctgcgccgtgccgtttttggcggatttgggcgtggaactgatagactgccagcaggatacggaacatatgcgccgtttcggttcggagctgctgccgtttgcggattttgccgaacgtctgcggatgttgaacgccgtgccgttgaaagaggaaatcgggcggcgcgaagtggcgtgcaaggggctt

SEQ ID NO: 7266 - protein, 241 aa, Neisseria gonorrhoeae
MRIPLLAPDNYAFPDPAYALARCDGLVGVSRDLDAGRLLEAYRNGVFPWFSRDGWFFWYAVGPRAVIVPERLHVPRSLAKTLRNGSYRVAVNGCFAEVVAHCAAAARPNQDGTWIAPEFQTAYLKLHEMGHAHSFECHYPDENGKTRLAGGFYGVQIGRVFYGESMFALQPDASKIAFACAVPFLADLGVELIDCQQDTEHMRRFGSELLPFADFAERLRMLNAVPLKEEIGRREVACKGL

SEQ ID NO: 7267 - DNA, 327 bp, Neisseria gonorrhoeae
atatggttttgtcgttcggcaaaatgtgtgctgtgattgatacgaaaacgaagtttcagcgaagctaaaatggctaaattcgctcacatctaatacatcatagctacgataacaatccgtataaacaatactgtcaggtttcacttgttcacggataataggaaataaagtagcggtttgagtattcggtactgtaaccgtataaaccttaccatttcgcttcaaaagaccgaatacggcgactttaccggcagcaccgcgaccgcgtttgcctttgcgttgtccgccaaaataactttcatctgcttctacttcgccatcaaacat

SEQ ID NO: 7268 - protein, 11 aa, Neisseria gonorrhoeae
IWFCRSAKCVL

SEQ ID NO: 7269 - DNA, 420 bp, Neisseria gonorrhoeae
atgaataaaaaccgcaaattactgcttgccgcactgctgctgactgcctttgccgccttcaagctcgttttgttgcaatggtggcaggcgcagcagccgcaagccgtggcggcgcaatgcgatttgaccgagggttgcacgctgccggacggaagccgtgtccgcgccgccgccgtttcaaccaaaaaaccgtttgatatttatatcgaacacgcgcccgccggcacggaacaggtcagcatcagcttcagtatgaaaaatatggatatgggtttcaaccgctatatgttcgagcggcaaccgtcggggacttggcaggcagcacgcatccgcctgcccgtctgtgtcgaaggcaggcgcgattttacggcggacattacaatcggcagccggacatttcagacggcatttaccgccgaa

SEQ ID NO: 7270 - protein, 140 aa, Neisseria gonorrhoeae
MNKNRKLLLAALLLTAFAAFKLVLLQWWQAQQPQAVAAQCDLTEGCTLPDGSRVRAAAVSTKKPFDIYIEHAPAGTEQVSISFSMKNMDMGFNRYMFERQPSGTWQAARIRLPVCVEGRRDFTADITIGSRTFQTAFTAE

SEQ ID NO: 7271 - DNA, 501 bp, Neisseria gonorrhoeae
gtgatagtgggcaagcaggctgaaattgcgtattatagcgtctattattttacagggatattgaatattatggaaaaattcagcaacattgcgcaactgaaagacagcggtctgaaggttaccggcccgcgtttgaagattttggatttgttcgagaagcacgcggaagagcatttgagtgcggaagatgtgtaccgcattctgctggaagagggcgtggaaatcggtgtggcgacgatttaccgcgtgctgacgcagttcgagcaggcgggcattctgcaacgccaccattttgaaacgggcaaggcggtttatgagttggacaagggcgaccaccacgaccatatcgtctgcgtgaagtgcggcgaggtaacggaattccacaatcccgaaatcgaagccctgcaagacaaaatcgccgaggaaaacggctaccgcatcgtcgatcacgcgctttatatgtacggcgtgtgcagcgactgtcaggccaagggcaaacgt

SEQ ID NO: 7272 - protein, 167 aa, Neisseria gonorrhoeae
VIVGKQAEIAYYSVYYFTGILNIMEKFSNIAQLKDSGLKVTGPRLKILDLFEKHAEEHLSAEDVYRILLEEGVEIGVATIYRVLTQFEQAGILQRHHFETGKAVYELDKGDHHDHIVCVKCGEVTEFHNPEIEALQDKIAEENGYRIVDHALYMYGVCSDCQAKGKR

SEQ ID NO: 7273 - DNA, 153 bp, Neisseria gonorrhoeae
ttgcaggtaaaatatcaaaccattaatttaaatcatatttttacagaatattccgccgcgttcaccaaatggacatcaaaccggttccaaatttctgtaattttgcaacaaaataccgcaaaacacccgattgagaccgaaaggactttcata

SEQ ID NO: 7274 - protein, 51 aa, Neisseria gonorrhoeae
LQVKYQTINLNHIFTEYSAAFTKWTSNRFQISVILQQNTAKHPIETERTFI

SEQ ID NO: 7275 - DNA, 531 bp, Neisseria gonorrhoeae; identical to SEQ ID NO: 4921

SEQ ID NO: 7276 - protein, 177 aa, Neisseria gonorrhoeae; identical to SEQ ID NO: 4922

SEQ ID NO: 7277 - DNA, 807 bp, Neisseria gonorrhoeae
atgatccaagatacccgcccccttatccgcgtcgttgccggcatcctgctcgattcagacggcaattacctgctcggctcgcgccccgaaggcaagccctatgccggatattgggaatttgccggcggcaaggtcgaggcgggcgaaaccgacttccaagccctgcaacgcgagtttggagaagaactcggcatccgcatcctcgccgccacgccttggctgaccaaaatccattcctacgaacacgcccgcgtctgcctgaaattcttatgggtaaaccccgatcaatgggagggcggaccgcaatcgcgcgaagggcaggaatggtcttggcagaaggcgggtgattttaccgttgcccccatgctgcctgccaacggtgcgcttttgcgttcgctgtccgtcccgcgccgtttgtacggcagcctgaaaacaggtttgtacggcgaaaacagtatgggcgcgtaccgcgtcctgcctttgggttcggcagggggaagcggtgcgaacgttttgatggaggcggcacaatggcaggacaggtccgaacacgccggcagcgtgtggatgatggtgcagacccgcgaacaatggcggcaggcgcaggaaaagggcgcggatgtggtcgtgtggcgcgtgtgcgatgatgttcaggcacaagaggcggcagaagccctgcggcagggcgtatccgtgccgctcgtacttgcagcaaacggacagacggttgcacgttatggaaaactatggctcggattgggggcgcacgcggtggtaagggatgaaacaatagggaagaatcatgaa

SEQ ID NO: 7278 - protein, 269 aa, Neisseria gonorrhoeae
MIQDTRPLIRVVAGILLDSDGNYLLGSRPEGKPYAGYWEFAGGKVEAGETDFQALQREFGEELGIRILAATPWLTKIHSYEHARVCLKFLWVNPDQWEGGPQSREGQEWSWQKAGDFTVAPMLPANGALLRSLSVPRRLYGSLKTGLYGENSMGAYRVLPLGSAGGSGANVLMEAAQWQDRSEHAGSVWMMVQTREQWRQAQEKGADVVVWRVCDDVQAQEAAEALRQGVSVPLVLAANGQTVARYGKLWLGLGAHAVVRDETIGKNHE

SEQ ID NO: 7279 - DNA, 1470 bp, Neisseria gonorrhoeae
atgaaccagacaagccgcgatctgacccgcatcagccacaacaccaaaatcgtcgccacccttgggccgggcagcaacaacgtcgaactgttggaagacatgatccgcgtcggcggcctgaacgtcgtccgcttcaacttcagccacggcacgcccgaattccatcaggaaaacgcccgcatcgtgcgcgaggcggcaaaacgcgccggacaggaaatcgccatcattgccgatctgcagggcccgaaaatccgcgtgggcaaaatcgccggcggcggcatcgaattgaacaaaggcgaaacattggtactcgatgccgcgctcgaaggcgaaggcacgcgcgaggcggtcggtttggactaccgcgacctgcccgacgacgttgccgcaggcgatgtcttgtggctggacgacggcctgctgaccctgaccgtggaatccgtcgaaggcagcaggattatcacaagggtggaaaacagccacatcctgaaaagcaacaaaggcatcaacaaacgcggcggcggtttgtccgcaggcgcgttgaccgaaaaagacttccgcgacctgaaaaccgcgattgccatcggttgcgactacctcgccatcagctttgtgaaatccgccgaagacctgcacatcgcgcgcgccaaagtcgaagaggaaatgaagggcagcactgccgtccgccccggtttggtttccaaaatcgaacgcgtagaagcgattgaaaaccttgatgaaatcatccttgccggcgacggcattatggttgcgcgcggcgacttggcggtcgaagtcggacacgccgccgtccccgccctgcaaaaacggatgatccgccgcgcccgcgagttgcgccgcttcagcattacggcgacgcaaatgatggaatcgatgattaccaaccccgtgccgacccgcgcggaagtcagcgatgtggcaaacgcggtattggacggcaccgatgcggtgatgtgttccgccgaaaccgccgtcggcgcgtatccgtttgaaaccgtcagccaaatggcgattatctgcgcggctgcggaaaaagagcaggattcgctcaacggcgttgccgaacagacggagtatcccgaagccgtcagcaccaacttagcgattgccggcggcgcggtcagcgtggcgcgcgcggttcacgccaaagccatcgtcgccctgaccgaaagcggttcgaccgcctttgaaatcagccgccacaatattaccctgccgattttcgcgctgaccccgagcgtttccgcccaacgccgtatggcgatgtaccggggcgtgcgcccgctgattttggcaaccagcaccgaccacgacacggcgttgaacgaagtcgaaacgatgctggtggaacacaacatcctgcattccggcgaccagtacatcatcaccagcggctcgcaaatgcgcgaatccggttcgaccaatacgctggaagtgctgcgcgtcaaa

SEQ ID NO: 7280 - protein, 490 aa, Neisseria gonorrhoeae
MNQTSRDLTRISHNTKIVATLGPGSNNVELLEDMIRVGGLNVVRFNFSHGTPEFHQENARIVREAAKRAGQEIAIIADLQGPKIRVGKIAGGGIELNKGETLVLDAALEGEGTREAVGLDYRDLPDDVAAGDVLWLDDGLLTLTVESVEGSRIITRVENSHILKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQTEYPEAVSTNLAIAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 7281 - DNA, 375 bp, Neisseria gonorrhoeae; identical to SEQ ID NO: 4961

SEQ ID NO: 7282 - protein, 125 aa, Neisseria gonorrhoeae; identical to SEQ ID NO: 4962

SEQ ID NO: 7283 - DNA, 375 bp, Neisseria gonorrhoeae
atgatttacggcatcggtacagacatcgtttccctcaagcgcatcatccgcttaaacaaaaaattcggacaggcgtttgcagggcgcatactcactcccgaagagctgcttgaatttccgcaggcgggcaaacccgtcaactaccttgccaaacgctttgccgccaaagaagccttcgccaaagccgtcggcacgggcatacgaggcgcggtttccttctgcaacatcggcatcgggcacgacgcattgggcaagcccgaatttttctacggccccgccctgtccgaatggctggaagaacaaggcatcagccgcgtcagcctgagtatggcggacgaaggcgataccgtgttggcgtttgccgttgccgaaaaa

SEQ ID NO: 7284 - protein, 125 aa, Neisseria gonorrhoeae
MIYGIGTDIVSLKRIIRLNKKFGQAFAGRILTPEELLEFPQAGKPVNYLAKRFAAKEAFAKAVGTGIRGAVSFCNIGIGHDALGKPEFFYGPALSEWLEEQGISRVSLSMADEGDTVLAFAVAEK

SEQ ID NO: 7285 - DNA, 423 bp, Neisseria gonorrhoeae
gtgtgttccttattgtttgtctgcgttttgtttcgcgcggagggcttcggcggcattttggagggcgtcgccttcggtgcggacgagtacgccgttttcaaaatagacggtcaggttgctgcgttctttgatgatgccgttgcgggaggtgttgaaggtatagtcccagcggtcggtatggaaagcgtcgcgcagtatggggctgccgagcaggagcaggacttggtctttggtcatgccggggcgcagggcggcaacggcgcgcggttcgagttcgttgccttggatgattttgagtttgtaggagggaaacagcgagacgcgttcgacgctgcacgcggtcaggctgaacagggcggaaagggcgaggatgagggttttgttcacgggagaacctttctgtgcaaatcgggatgtctagtg

SEQ ID NO: 7286 - protein, 141 aa, Neisseria gonorrhoeae
VCSLLFVCVLFRAEGFGGILEGVAFGADEYAVFKIDGQVAAFFDDAVAGGVEGIVPAVGMESVAQYGAAEQEQDLVFGHAGAQGGNGARFEFVALDDFEFVGGKQRDAFDAARGQAEQGGKGEDEGFVHGRTFLCKSGCLV

SEQ ID NO: 7287 - DNA, 126 bp, Neisseria gonorrhoeae
gaatttttttgccttgcagaaaacccattttgtatccttcaaatagtgttcggttcgttctaaaccgttgattatagcaaattgtccctgtttctgtgttttcacgttgcagcgtgcagacggcaa

SEQ ID NO: 7288 - protein, 20 aa, Neisseria gonorrhoeae
EFFCLAENPFCILQIVFGSF

SEQ ID NO: 7289 - DNA, 282 bp, Neisseria gonorrhoeae
gtgccaagtctacaaaggagaagtagaggagaaaaatcaagctgcatcaagcaactcaacggcggtaattatccgccgtttcttatctgctgtcaattattttttgaaaatttacccgaccgattcaaattttgcaaaaaacttgcccgatggctatccggtaacaaattccctcaaaaacccgtcaatccgattattcaaaaaatcatatgctttcatcgtgtttccttttcggttgaaaccctgccctttagggcggtagaatcagactttatagtggat

SEQ ID NO: 7290 - protein, 94 aa, Neisseria gonorrhoeae
VPSLQRRSRGEKSSCIKQLNGGNYPPFLICCQLFFENLPDRFKFCKKLARWLSGNKFPQKPVNPIIQKIICFHRVSFSVETLPFRAVESDFIVD

SEQ ID NO: 7291 - DNA, 1185 bp, Neisseria gonorrhoeae; identical to SEQ ID NO: 2991

SEQ ID NO: 7292 - protein, 395 aa, Neisseria gonorrhoeae; identical to SEQ ID NO: 2992

SEQ ID NO: 7293 - DNA, 408 bp, Neisseria gonorrhoeae
atgccgccttacttcatcaccctcttaacgatggaaaatacaaaaagcgcggcgaaaacgcccactacaatccaaccggcttccataccgtccgcttttgcggcttccaaagcgttttttgccgtttcgggcaacgctgcgtttgcctgtgccgccaaagccagcggggcggctgttacaacagccagttttgcgccgtatttacggcaggtgttaataaatttcatgatattttccttcaaaaagtgtttggcggtaatggatggagagtttttcagacgaccgccgaacatccgaaaatcagtctttcaaaaatccgaatacgacaaattcgcattggttgccgatttcttccaaacctgcgttaaccgcttcttcgaagtcgtagaaataatcggcattggtaat

SEQ ID NO: 7294 - protein, 136 aa, Neisseria gonorrhoeae
MPPYFITLLTMENTKSAAKTPTTIQPASIPSAFAASKAFFAVSGNAAFACAAKASGAAVTTASFAPYLRQVLINFMIFSFKKCLAVMDGEFFRRPPNIRKSVFQKSEYDKFALVADFFQTCVNRFFEVVEIIGIGN

SEQ ID NO: 7295 - DNA, 891 bp, Neisseria gonorrhoeae
ttgttgataatatcgaatgttagaaaaggagaaaacatgtctgaagaaaaattgaaaatgagtttcgagccaaccgtaatcgaacatttgggtgtaaagatgtattcgcacactgttcctgcgattgccgagttgatagcgaatgcctacgatgcatgtgctacggaagtggaagttaggttattcgataaaccggagcataaaatcgttattaaagataatggcataggaatgagcttcgatgaaatcaatgatttttatttgagaatcggtcggaacagaagggaagaaaaacaagcctccccgtgcggaagaattccaacgggtaaaaaaggtcttggtaaattggcattattcaggcttggcaacaaaatcgaaatctctactatccaaggaaacgaacgggttacttttactttggattatgcagagattaaaaaaagtgagcgtatttatcaaccggagtttcagaaagagtctgttaaacccaataccgaaaacggaacaactataactttaaccgagctgacgaaaaaacaaggatacccgttagataattatgtggggcatctttcccgtttatttgattttccggctcaggattttaaaatcaaagtaagcttgaacggctcggaaccaagaatcattgacggaaacctaaaatataatcttgttaccccacaattcgaatgggaataccaggatctagcaaccaatatttcatcgttatcttcaaaattcgaacagtatgaatacagcggattaatacaaggtaagttcattacaacggaaaaacctttaaagaataatatgaaaggtattaccttgtttgccaacggcagaatggtaaatatgcccgagtttttcactgatagcgaatccagccatttc

SEQ ID NO: 7296 - protein, 297 aa, Neisseria gonorrhoeae
LLIISNVRKGENMSEEKLKMSFEPTVIEHLGVKMYSHTVPAIAELIANAYDACATEVEVRLFDKPEHKIVIKDNGIGMSFDEINDFYLRIGRNRREEKQASPCGRIPTGKKGLGKLALFRLGNKIEISTIQGNERVTFTLDYAEIKKSERIYQPEFQKESVKPNTENGTTITLTELTKKQGYPLDNYVGHLSRLFDFPAQDFKIKVSLNGSEPRIIDGNLKYNLVTPQFEWEYQDLATNISSLSSKFEQYEYSGLIQGKFITTEKPLKNNMKGITLFANGRMVNMPEFFTDSESSHF

SEQ ID NO: 7297 - DNA, 273 bp, Neisseria gonorrhoeae
gtgcaaatccggcaacatcggataaaatcgagtgcctatactaaagcgaaacaaggcatttccgactgccttttttatttgtccaccgtccgcctttttacggaaaccgaaatgacccctttcacactgaaaaaaccgtcctgctgctcggcactgcctttgccgccgcatctgtccacgcatccggctaccacttcggcacacagtcggtcaacgcgcaaagcacggcaaatgccgccgacgcgtcgaccatcttctacaatcccgccggcc

SEQ ID NO: 7298 - protein, 91 aa, Neisseria gonorrhoeae
VQIRQHRIKSSAYTKAKQGISDCLFYLSTVRLFTETEMTPFTLKKPSCCSALPLPPHLSTHPATTSAHSRSTRKARQMPPTRRPSSTIPPA

SEQ ID NO: 7299 - DNA, 786 bp, Neisseria gonorrhoeae
atgccgtctgaaacggtttgcctgcccttacggcagcagccttgccctgaacatcgcctccttcatctggcgcacggcttcgggaagtccgaggaagagggcttgggcaatcagcgaatgcccgatgttcagttcgcggatggcgaggatttgggcgacgggggtaacgttgtgtatggtcagtccgtgtccggcgttgacgaccaagcccaaatcgccggcgaaatgcgcgccgttttggatgcgctcgaactgcctgatttgttcggcgtggctttgtgcgtcggcatatgcgccggtgtgcagctcgacaacgggcgcgccgacatcacgggcggcttggatttgcctgtcgtcggcatcgataaacaaggacacgcgtatgcccgcgtcggtcaggattttggcgaattcggcgattttttcctgttgcgccaatacgtccaaaccgccttcggtcgtgatttcctgccgtttttcaggcacgatgcacacgtcttccggcatcactttaagcgcgttttcgagcatttcttccgtcaacgccatttcaaggttcaggcgcgtgcggatggcgtttttgacggcaaatacatccgcgtctttgatgtggcggcggtcttcgcgcaggtgcatggtaatcaggtctgcaccgtgcgtttcggcaaccagtgccgcctccacggggctgggataagtcgtgccgcgcgcgttgcggacggtggcgatgtggtcgatgttgacacccagaagcataatgtttccttttctcttcgttttcctgtt

SEQ ID NO: 7300 - protein, 262 aa, Neisseria gonorrhoeae
MPSETVCLPLRQQPCPEHRLLHLAHGFGKSEEEGLGNQRMPDVQFADGEDLGDGGNVVYGQSVSGVDDQAQIAGEMRAVLDALELPDLFGVALCVGICAGVQLDNGRADITGGLDLPVVGIDKQGHAYARVGQDFGEFGDFFLLRQYVQTAFGRDFLPFFRHDAHVFRHHFKRVFEHFFRQRHFKVQARADGVFDGKYIRVFDVAAVFAQVHGNQVCTVRFGNQCRLHGAGISRAARVADGGDVVDVDTQKHNVSFSLRFPV

SEQ ID NO: 7301 - DNA, 807 bp, Neisseria gonorrhoeae; identical to SEQ ID NO: 4999

SEQ ID NO: 7302 - protein, 269 aa, Neisseria gonorrhoeae; identical to SEQ ID NO: 5000

SEQ ID NO: 7303 - DNA, 345 bp, Neisseria gonorrhoeae
gtgctgcccagcattcattatgaagcagattccgccaccgactttaccgggcttcccgtccaaggttctaaaaacggcaaaatcaccaaaaccacggtcgcaccccacatttacggcgcatacaaagtcaacgacaatctgaccgtgggcttgggcgtgtacgtccccttcggctctgccaccgaatacgaaaaagattccgtgttgcgccacaacatcaacaaactcggtctgaccagcatcgccgtcgaacctgtcgccgcgtggaaactcaacgaacgccattccttcggcgcaggcatcatcgcccaacataattccgccgaactgcgcaaatatgccgac

SEQ ID NO: 7304 - protein, 115 aa, Neisseria gonorrhoeae
VLPSIHYEADSATDFTGLPVQGSKNGKITKTTVAPHIYGAYKVNDNLTVGLGVYVPFGSATEYEKDSVLRHNINKLGLTSIAVEPVAAWKLNERHSFGAGIIAQHNSAELRKYAD

SEQ ID NO: 7305 - DNA, 726 bp, Neisseria gonorrhoeae
atgcttctgggtgtcaacatcgaccacatcgccaccgtccgcaacgcgcgcggcacgacttatcccagccccgtggaggcggcactggttgccgaaacgcacggtgcagacctgattaccatgcacctgcgcgaagaccgccgccacatcaaagacgcggatgtatttgccgtcaaaaacgccatccgcacgcgcctgaaccttgaaatggcgttgacggaagaaatgctcgaaaacgcgcttaaagtgatgccggaagacgtgtgcatcgtgcctgaaaaacggcaggaaatcacgaccgaaggcggtttggacgtattggcgcaacaggaaaaaatcgccgaattcgccaaaatcctgaccgacgcgggcatacgcgtgtccttgtttatcgatgccgacgacaggcaaatccaagccgcccgtgatgtcggcgcgcccgttgtcgagctgcacaccggcgcatatgccgacgcacaaagccacgccgaacaaatcaggcagttcgagcgcatccaaaacggcgcgcatttcgccggcgatttgggcttggtcgtcaacgccggacacggactgaccatacacaacgttacccccgtcgcccaaatcctcgccatccgcgaactgaacatcgggcattcgctgattgcccaagccctcttcctcggacttcccgaagccgtgcgccagatgaaggaggcgatgttcagggcaaggctgctgccg

SEQ ID NO: 7306 - protein, 242 aa, Neisseria gonorrhoeae
MLLGVNIDHIATVRNARGTTYPSPVEAALVAETHGADLITMHLREDRRHIKDADVFAVKNAIRTRLNLEMALTEEMLENALKVMPEDVCIVPEKRQEITTEGGLDVLAQQEKIAEFAKILTDAGIRVSLFIDADDRQIQAARDVGAPVVELHTGAYADAQSHAEQIRQFERIQNGAHFAGDLGLVVNAGHGLTIHNVTPVAQILAIRELNIGHSLIAQALFLGLPEAVRQMKEAMFRARLLP

SEQ ID NO: 7307 - DNA, 651 bp, Neisseria gonorrhoeae
tttgtccaccgtccgcctttttacggaaaccgaaatgacccctttcacactgaaaaaaccgtcctgctgctcggcactgcctttgccgccgcatctgtccacgcatccggctaccacttcggcacacagtcggtcaacgcgcaaagcacggcaaatgccgccgacgcgtcgaccatcttctacaatcccgccggcctgaccaaactcgacagcagccagatttccgtcaacgccaacatcgtgctgcccagcattcattatgaagcagattccgccaccgactttaccgggcttcccgtccaaggttctaaaaacggcaaaatcaccaaaaccacggtcgcaccccacatttacggcgcatacaaagtcaacgacaatctgaccgtgggcttgggcgtgtacgtccccttcggctctgccaccgaatacgaaaaagattccgtgttgcgccacaacatcaacaaactcggtctgaccagcatcgccgtcgaacctgtcgccgcgtggaaactcaacgaacgccattccttcggcgcaggcatcatcgcccaacataattccgccgaactgcgcaaatatgccgactgaggaatcccaaaaaaagcgcaaatgctgcaagcaacaccttctaatcctactgccgctgctcaa

SEQ ID NO: 7308 - protein, 195 aa, Neisseria gonorrhoeae
FVHRPPFYGNRNDPFHTEKTVLLLGTAFAAASVHASGYHFGTQSVNAQSTANAADASTIFYNPAGLTKLDSSQISVNANIVLPSIHYEADSATDFTGLPVQGSKNGKITKTTVAPHIYGAYKVNDNLTVGLGVYVPFGSATEYEKDSVLRHNINKLGLTSIAVEPVAAWKLNERHSFGAGIIAQHNSAELRKYAD

SEQ ID NO: 7309 - DNA, 102 bp, Neisseria gonorrhoeae
ttgtcatgctgcacaagcaactttattgatatgccgatacgaagcctgtcggcaaaatgccgtctgaacaatatcttttcagacggcattttgtatgggggt

SEQ ID NO: 7310 - protein, 34 aa, Neisseria gonorrhoeae
LSCCTSNFIDMPIRSLSAKCRLNNIFSDGILYGG

SEQ ID NO: 7311 - DNA, 804 bp, Neisseria gonorrhoeae
atgctgcaagcaacaccttctaatcctactgccgctgctcaaatcaaggccgacggacacgccgatgtcaaaggcagcgattggggcgtcggctaccaactggcgtggatgtgggacatcaacgaccgcgcgcgcgtgggcgtgaactaccgttccaaagtttcacacacgctcaaaggcgatgccgaatgggcggcagacggcgcggcggcgaaacaacagtggaatgacaatatgctcacaccgctcggttacacggcgaatgaaaaagccagtgtcaaaatcgtaacgcctgagtctttgtccgtacacggcatgtacaaagtgtccgacaaagccgacctgttcggcgacgtaacttggacgcgccacagccgcttcaataaggcggaactgttttttgaaaaagaaaaaaatattgctaatggcaaaaaatccgaccgcaccaccatcacccccaactggcgcaacacctacaaagtcggcttgggcggttcttatcaaatcagcgaaccgctgcaactgcgcgtcggcatcgcttttgacaaaccgcctgtccgcaacgccgactaccgcatgaacagcctgcccgacggcaaccgcatctggttctccgccggcatgaaataccatatcggcaaaaaccacgtcgtcgatgccgcctacacccacatccacatcaacgacaccagctaccgcacggcgaaggcaagcggcaacgatgtggacagcaaaggtgcgtcttgcgcacgtttcaaaaaccacgccgacatcatcggcctgcaatacacctacaaattcaaa

SEQ ID NO: 7312 - protein, 268 aa, Neisseria gonorrhoeae
MLQATPSNPTAAAQIKADGHADVKGSDWGVGYQLAWMWDINDRARVGVNYRSKVSHTLKGDAEWAADGAAAKQQWNDNMLTPLGYTANEKASVKIVTPESLSVHGMYKVSDKADLFGDVTWTRHSRFNKAELFFEKEKNIANGKKSDRTTITPNWRNTYKVGLGGSYQISEPLQLRVGIAFDKPPVRNADYRMNSLPDGNRIWFSAGMKYHIGKNHVVDAAYTHIHINDTSYRTAKASGNDVDSKGASCARFKNHADIIGLQYTYKFK

SEQ ID NO: 7313 - DNA, 312 bp, Neisseria gonorrhoeae
ttgtttcatttgttcttcgtaaatttctattttaggcaattgtgccctacaccaaattacacagactgggtaaaaattaaattcaagcagttcagctatctgaaatttatctatggatacgctacggagaaccaagataaagatatcgataataccttggagcttggagaattaaagcaggatgatgaaatcttggattatggaggtgcactggcattaatagggcgtaggtataatcttccgaccagttttatcatagatatagtttgccgggaaatagagttggaatttttagatcaggagagtttcaat

SEQ ID NO: 7314 - protein, 104 aa, Neisseria gonorrhoeae
LFHLFFVNFYFRQLCPTPNYTDWVKIKFKQFSYLKFIYGYATENQDKDIDNTLELGELKQDDEILDYGGALALIGRRYNLPTSFIIDIVCREIELEFLDQESFN

SEQ ID NO: 7315 - DNA, 96 bp, Neisseria gonorrhoeae
ttgcgcacgtttcaaaaaccacgccgacatcatcggcctgcaatacacctacaaattcaaataaacgttacaccgtttgaatataaaaatgccgtc

SEQ ID NO: 7316 - protein, 32 aa, Neisseria gonorrhoeae
LRTFQKPRRHHRPAIHLQIQINVTPFEYKNAV

SEQ ID NO: 7317 - DNA, 156 bp, Neisseria gonorrhoeae
atggattattttcccgaagcagcacgtattacaaaaaaagggggagaaattgtgattaatggcacatcaaacaataagtatttaagaggaattccaaatgaaacagaactggcccgaatgggattaaggttaaaatataatggttcgttaactgat

SEQ ID NO: 7318 - protein, 52 aa, Neisseria gonorrhoeae
MDYFPEAARITKKGGEIVINGTSNNKYLRGIPNETELARMGLRLKYNGSLTD

SEQ ID NO: 7319 - DNA, 741 bp, Neisseria gonorrhoeae
atgtccgaataccgagtcaaccacgaacccgtttttatgctggcatcttcgccttggcgcgaaagcagcctgcgggttgaagcattcagccgccgttacgggcgtgtggctttgctggcgcgcagcgcgcgcaaacggcagagcgagctgcgcggcgtattggttccgttcgtccctgccagcgtgtcgtggtacggcagtcaggaactcaaaaccctgcaccgcgccgaatggatgggcggatggcggcagccgcagggcagggcgttgttcagcggtctgtatgtgaacgagctggtgttgaaactgaccgcgcgcgaagacccgatgtccgaactgtacgacgcgttggcaaaagtgatggaggcagtgtgccgtgaagccaaccatattgccgatttgcgccgcttcgaatggaagctgctcaatgccttgggcgttgcccccgatttgcacgccgacggcacgggcggcgatattttggcggacaaaacctaccggctgatgcccgaagaggcggtcatgcccgtatgccgggacacaggcgcgctttcgcacgaagccggcgcaattgtcgaagggcagagcctgatcgatttgcgcgaaggcagtttccgcaccgccgaaagcctgcaacaggcattgaaaatcacacggctgctaatcggcacgctgcttcccgaaggcttgaaatcgcggcaggtgttggaacagataaggcagttcgaccgcaataccgcg

SEQ ID NO: 7320 - protein, 247 aa, Neisseria gonorrhoeae
MSEYRVNHEPVFMLASSPWRESSLRVEAFSRRYGRVALLARSARKRQSELRGVLVPFVPASVSWYGSQELKTLHRAEWMGGWRQPQGRALFSGLYVNELVLKLTAREDPMSELYDALAKVMEAVCREANHIADLRRFEWKLLNALGVAPDLHADGTGGDILADKTYRLMPEEAVMPVCRDTGALSHEAGAIVEGQSLIDLREGSFRTAESLQQALKITRLLIGTLLPEGLKSRQVLEQIRQFDRNTA

SEQ ID NO: 7321 - DNA, 465 bp, Neisseria gonorrhoeae
tctcggtattcgggagaatatatacagaacctccttcatatcaaaatggtagggacgctcgggcaacaggacggcggcaggcagcttggtgatgccgttcaaaccgcgcgggaacagcgcaatccgctctttgcccttttccgcataatctgctttgcggttgtggatggaaactacttcgcgatggcggtaaagcagcgtgttcatttcgatataggcttcgttgtggatggctgccgactgtttctgcaacacgtcaatctgcctgttgagcttgtcgttggctttcatcagcctgttgaagaacgacggttgctcctgcagtttggcggtacaggcttcgatactttccgataccggcccgaactgttcgaggtatttttccagacagttttccaagtcggtcaggcagccggccatcttgcgggaaaattcttcttcaggctttccctgccgaatggacaa

SEQ ID NO: 7322 - protein, 155 aa, Neisseria gonorrhoeae
SRYSGEYIQNLLHIKMVGTLGQQDGGRQLGDAVQTAREQRNPLFALFRIICFAVVDGNYFAMAVKQRVHFDIGFVVDGCRLFLQHVNLPVELVVGFHQPVEERRLLLQFGGTGFDTFRYRPELFEVFFQTVFQVGQAAGHLAGKFFFRLSLPNGQ

SEQ ID NO: 7323 - DNA, 1185 bp, Neisseria gonorrhoeae
ttgttaatccactatatgtggggacagacgaatatggttgataaaaaaagccctttgattgccgtcagtgtcggcgaagcgtcgggcgacctgttgggggcgcacctgatacgcgccatccgaaagcgttgcccgcaggcacggttaaccggcatcggcggggaactgatgaaggcggaaggtttcgagagcctttatgatcaggagcggctggcggtgcgcggctttgtcgaagtggtcaggcggctgccggaaattttacggatacgcagggagctggtacgggatttgctgtcgttgaaacctgatgtctttgtcggtatcgatgcgcccgattttaatctgggtgtggcggaaaagctgaaacgggcgggcattccgaccctgcattatgtcagtccgtcggtttgggcgtggcggcgcgaacgcgtgggcaaaatcgtgcatcaggtcaaccgcgtgctgtgcctgttcccgatggagccgcagctttatctcgatgcgggcggacgtgcggagtttgtcggtcatccgatggcacagcttatgcccttggaagacgaccgtgaaacggcgcggaaaactttgggcgcggatgtcggcatccccgtattcgccctgctgcccggcagccgcgtcagcgaaatcgactatatggcgccggtgttttttcagacggcattattgttgttggaacgctatcccgccgcccgcttcctgctgcctgccgcaacggaggcgacgaagcggcgtttggcggaagttttgcagcggccggagtttgccggattggcgctgacggtaaccgacagacagtctgaaacggtgtgcagggcggcggatgcggtgctggtaacgagcggtacggcgactttggaggtggcgttgtgcaagcgtccgatggtcatcagctacaagatttcgccgctgacctatgcttatgtgaaacgcaaaatcaaagtgccgcatgtcggcctgccgaatatcctgttgggtaaggaggccgtgccggaattattgcaatctgaagcaaaaccggaaaaactggcggcggcattggcggactggtacgaacaccccgataaggttgccgcgctgcaacaggatttcggggcgttgcacctgctgttgaaaaaagatacggcggatttggccgcgcgcgcggttttggaagaggcgggatgt

SEQ ID NO: 7324 - protein, 395 aa, Neisseria gonorrhoeae
LLIHYMWGQTNMVDKKSPLIAVSVGEASGDLLGAHLIRAIRKRCPQARLTGIGGELMKAEGFESLYDQERLAVRGFVEVVRRLPEILRIRRELVRDLLSLKPDVFVGIDAPDFNLGVAEKLKRAGIPTLHYVSPSVWAWRRERVGKIVHQVNRVLCLFPMEPQLYLDAGGRAEFVGHPMAQLMPLEDDRETARKTLGADVGIPVFALLPGSRVSEIDYMAPVFFQTALLLLERYPAARFLLPAATEATKRRLAEVLQRPEFAGLALTVTDRQSETVCRAADAVLVTSGTATLEVALCKRPMVISYKISPLTYAYVKRKIKVPHVGLPNILLGKEAVPELLQSEAKPEKLAAALADWYEHPDKVAALQQDFGALHLLLKKDTADLAARAVLEEAGC

SEQ ID NO: 7325 - DNA, 474 bp, Neisseria gonorrhoeae
atggtagggacgctcgggcaacaggacggcggcaggcagcttggtgatgccgttcaaaccgcgcgggaacagcgcaatccgctctttgcccttttccgcataatctgctttgcggttgtggatggaaactacttcgcgatggcggtaaagcagcgtgttcatttcgatataggcttcgttgtggatggctgccgactgtttctgcaacacgtcaatctgcctgttgagcttgtcgttggctttcatcagcctgttgaagaacgacggttgctcctgcagtttggcggtacaggcttcgatactttccgataccggcccgaactgttcgaggtatttttccagacagttttccaagtcggtcaggcagccggccatcttgcgggaaaattcttcttcaggctttccctgccgaatggacaatatagcggattaacaaaaatcaggacaaggcgacgaagccgcagacagtacaga

SEQ ID NO: 7326 - protein, 158 aa, Neisseria gonorrhoeae
MVGTLGQQDGGRQLGDAVQTAREQRNPLFALFRIICFAVVDGNYFAMAVKQRVHFDIGFVVDGCRLFLQHVNLPVELVVGFHQPVEERRLLLQFGGTGFDTFRYRPELFEVFFQTVFQVGQAAGHLAGKFFFRLSLPNGQYSGLTKIRTRRRSRRQYR

SEQ ID NO: 7327 - DNA, 156 bp, Neisseria gonorrhoeae
ggacggcacatagggcgacgctttatgtgccgtcctgtgtgttgaaacatcagcataggaaacacaggaaaagccggctgttttgcgcctgcgtaccgtattggtcaaaatgccgtctgaaaccgacaacagggtttcagacggcatttccgtcaa

SEQ ID NO: 7328 - protein, 14 aa, Neisseria gonorrhoeae
GRHIGRRFMCRPVC

SEQ ID NO: 7329 - DNA, 1128 bp, Neisseria gonorrhoeae
ttgatgttagaatgcacggcaaattaccgttcaggcgaaattatgtcccaaactatcgacgaactcctcatcccgcaccgcaacgccatcgacaccatcgatgccgaaattctgcgcctgctcaacgaacgcgcgcaacatgcccacgccatcggcgagctgaaaggcacgggcgcggtgtaccgccccgaacgcgaggttgccgtgttgcgccgcattcaggatttgaacaaaggcccgctgcccgacgaatcggtagcacgcctgtttcgggaagtgatgagcgagtgcctcgccgtcgaacgtccgctgaccatcgcctatctggggccgcagggcacgtttacccaacaggcggcaatcaagcatttcggacacgccgcgcatacaatggcgtgtccgaccatagacgactgcttcaaacaggttgaaacccgtcaggcggattatctggtcgcgcccgtggaaaactcgaccgaaggctcggtcgggcgcacattggatttgcttgccgttaccgcgttgcaggcgtgcggcgaagtcgttttgcgcatccaccacaacctgttgcgcaaaaacaacggcagcaccgagggtatcgccaaagtattttcgcacgcgcaggcgttggcgcagtgcaacgactggttgggcaggcgtctgcccaatgccgaacggattgccgtgtccagcaatgccgaagccgcaaggctggttgccgaatcggacgacggtacggttgccgccatcgccggacgcacggcggcggaaatttacggactcgatatggttgccgagtgcatcgaagacgaaccgaacaacaccacgcgctttctggtcatgggacatcacgaaaccggtgcaagcggcagcgacaaaacctcgctggccgtttccgcgcccaaccgcgccggcgcggttgcctcgctgctgcaaccgctgaccgaatcgggtatttccatgaccaagtttgagagccgtccgagcaaatccgttttgtgggaatacctgttcttcatcgacatcgaaggacaccgccgggacgcgcagattcagacggcattggaacgcttgggcgaacgcgcttcgtttgtcaaagccatcggttcgtatccgactgccgttttg

SEQ ID NO: 7330 - protein, 376 aa, Neisseria gonorrhoeae
LMLECTANYRSGEIMSQTIDELLIPHRNAIDTIDAEILRLLNERAQHAHAIGELKGTGAVYRPEREVAVLRRIQDLNKGPLPDESVARLFREVMSECLAVERPLTIAYLGPQGTFTQQAAIKHFGHAAHTMACPTIDDCFKQVETRQADYLVAPVENSTEGSVGRTLDLLAVTALQACGEVVLRIHHNLLRKNNGSTEGIAKVFSHAQALAQCNDWLGRRLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKAIGSYPTAVL

SEQ ID NO: 7331 - DNA, 1506 bp, Neisseria gonorrhoeae
ttgtttatgttcggcacggcgttcgggcaagtggccggcggcgcggtgtccgacatcaaagggcgcaaacccgtcgccctgaccggtttgattgtatattgccttgccgttgccgccatcgtatttgcttcgagtaccgaacagctccttaacctgcgtgcggtacaggcgttcggcgcaggcatggctgtagtcatcgtcggtgcgatggtgcgcgattattattccggacgcaaagccgcgcagatgtttgcccttatcggcatcattctgatggttgtgccgctggccgcacccatggtcggcgcattgttgcagggattgggcggatggcgggcgattttcgttttcttggcggcgtattcgccggtgctgcccggtttggtacagtatttcctgcccaatcccgccgtcggcggcaaaatcggcagggatgtgttcgggctggtggcggggcggttcaagcgcgtattgaaaacccgtgccgcgatgggttatctgttttttcaggcattcagcttcggttcgatgttcgcctttctgaccgaatcttccttcgtgtaccggcagctctaccacgttacgccgcaccggtacgcatgggtgtttgcactcaacatcatcacgatgatgtttttcagccgcgttaccgcgtggcggcttaaaaccggcgcgcatccgcaaagcatcctgctgcgggggattgtcgtccaatttgccgccaacccgtcccaactcgccgccgtgctgtttttcgggttgcccccgttttggctgccggtcgcgtgcgtgatgttttccgtcggtacgcagggcctggtcggtgcggacacgcaggcatgctttatgtcttatttcaaagaagagggcggcagcgcgaacgccgtgtcgggtgtattccggtccttaatcggcgcgggcgtggtcatggcggcaaccgtgatggcggcaaccatgaccgcgtccgcctcttgcggcattgcgcttttgtggctctgctcgcacaaggcgtggaaggaaaacgaaaaaaagcgaatacttgtaaaccgatgccgtccgaaaccgcttcagacggcatttgatgttagaatgcacggcaaattaccgttcaggcgaaattatgtcccaaactatcgacgaactcctcatcccgcaccgcaacgccatcgacaccatcgatgccgaaattctgcgcctgctcaacgaacgcgcgcaacatgcccacgccatcggcgagctgaaaggcacgggcgcggtgtaccgccccgaacgcgaggttgccgtgttgcgccgcattcaggatttgaacaaaggcccgctgcccgacgaatcggtagcacgcctgtttcgggaagtgatgagcgagtgcctcgccgtcgaacgtccgctgaccatcgcctatctggggccgcagggcacgtttacccaacaggcggcaatcaagcatttcggacacgccgcgcatacaatggcgtgtccgaccatagacgactgcttcaaacaggt

SEQ ID NO: 7332 - protein, 502 aa, Neisseria gonorrhoeae
LFMFGTAFGQVAGGAVSDIKGRKPVALTGLIVYCLAVAAIVFASSTEQLLNLRAVQAFGAGMAVVIVGAMVRDYYSGRKAAQMFALIGIILMVVPLAAPMVGALLQGLGGWRAIFVFLAAYSPVLPGLVQYFLPNPAVGGKIGRDVFGLVAGRFKRVLKTRAAMGYLFFQAFSFGSMFAFLTESSFVYRQLYHVTPHRYAWVFALNIITMMFFSRVTAWRLKTGAHPQSILLRGIVVQFAANPSQLAAVLFFGLPPFWLPVACVMFSVGTQGLVGADTQACFMSYFKEEGGSANAVSGVFRSLIGAGVVMAATVMAATMTASASCGIALLWLCSHKAWKENEKKRILVNRCRPKPLQTAFDVRMHGKLPFRRNYVPNYRRTPHPAPQRHRHHRCRNSAPAQRTRATCPRHRRAERHGRGVPPRTRGCRVAPHSGFEQRPAARRIGSTPVSGSDERVPRRRTSADHRLSGAAGHVYPTGGNQAFRTRRAYNGVSDHRRLLQTG

SEQ ID NO: 7333 - DNA, 990 bp, Neisseria gonorrhoeae
atgaaaacgcacgaaataagcaaaggttcggtcagcctgataggggttgccgaacatgaggcgggtcaacgccttgataactatctgataaaaatcctcaagggcgtgcccaagggctatatccaccgcattatccgcgccggcgaggtgcggttgaacaagaaacgctgcaaacccgacagccgtattgcggagggagatacggtgcggattccgcctgtgcgcgtggcggagaaggaaatgccgtctgaaaggcgtgccgccgtaccggcgcgtgcgtttgaggtggtgtatgaggacgacgcgctactggtggtcaataagccttccggtgtggcggtacacggtggcagcggcgtgagtttcggcgttatcgaacagttgcgccgcgcccgtccggaggcgaagtatttggagttggtccaccgtttggacaaggatacgagcggcttgttgatggtggcgaagaaacgcagcgcgctcgtcaaactgcacgaagctatccgtaacgaccaccccaaaaaaatctaccttgcgctgggggtgggcaaactgccggacgacaatttccatgtcaaactgcccctgttcaaatataccggcgcacaaggcgaaaagatggtacgcgtcagcgaggacgggcagtcggcgcatacggtgttccgtgtgttaagccgtttctcagacggcattttgcacggtgtcgggctgtcgcacctgactttggtgcgggcaacgctgaaaacgggccgtacgcaccaaatccgcgtgcatctgcaatctcaaggctgtccgattgcgggcgacgaacgctacggcgattatcaggcgaaccggcgtttgcagaaattgggtttgaagcgcatgtttttgcacgcgtccgagctgcacctgaaccatccgctcacgggtgagccgctggtgttgaaggcggagccgccgccggatttggcgcagtttgcggtgatgttggaaaacgggacgaaaatg

SEQ ID NO: 7334 - protein, 330 aa, Neisseria gonorrhoeae
MKTHEISKGSVSLIGVAEHEAGQRLDNYLIKILKGVPKGYIHRIIRAGEVRLNKKRCKPDSRIAEGDTVRIPPVRVAEKEMPSERRAAVPARAFEVVYEDDALLVVNKPSGVAVHGGSGVSFGVIEQLRRARPEAKYLELVHRLDKDTSGLLMVAKKRSALVKLHEAIRNDHPKKIYLALGVGKLPDDNFHVKLPLFKYTGAQGEKMVRVSEDGQSAHTVFRVLSRFSDGILHGVGLSHLTLVRATLKTGRTHQIRVHLQSQGCPIAGDERYGDYQANRRLQKLGLKRMFLHASELHLNHPLTGEPLVLKAEPPPDLAQFAVMLENGTKM

SEQ ID NO: 7335 - DNA, 141 bp, Neisseria gonorrhoeae
ttggcacacattctattgaatgtgtgcattttttatctgaagcaacaagcctctgtgcgtgatgttgttatgtttcatttagatgtcaaaccgcatacccggtctgaaatattcaatccaaatccaaaaccggattttctt

SEQ ID NO: 7336 - protein, 47 aa, Neisseria gonorrhoeae
LAHILLNVCIFYLKQQASVRDVVMFHLDVKPHTRSEIFNPNPKPDFL

SEQ ID NO: 7337 - DNA, 342 bp, Neisseria gonorrhoeae
atgaacatcatccgcgcgctcctcatcatcctcggctgcctcgccgccggcgaaaccgccgttttcctagcaggcatcaaactgcccggcagcatcgtcggcatgggcgtgctgtttgcgcttttgcaggcgggttgggtcaaaacgtcttggctgcaacagcttaccgacgcgctgatggcaaacctgacgctgttcctcgtgccgccctgcgtggcggtcatcagctatttggatttgattgccgacgattggttttcgatactggtttccgcctccgccagcactttgtgcgtactgctggttacgggcaaggttcaccgctggatacggagcattatc

SEQ ID NO: 7338 - protein, 114 aa, Neisseria gonorrhoeae
MNIIRALLIILGCLAAGETAVFLAGIKLPGSIVGMGVLFALLQAGWVKTSWLQQLTDALMANLTLFLVPPCVAVISYLDLIADDWFSILVSASASTLCVLLVTGKVHRWIRSII

SEQ ID NO: 7339 - DNA, 783 bp, Neisseria gonorrhoeae
tccctcggtgctcaaggcattaatgctgtaaccgccgtcaacataagtgatttcgccggtaatgccggacgacaggtcggacagcaggaaggcggcagtattcccgacttcttcgatggtaacgttgcggcgcagcgggttgtgggcggcgacgtgtcccaagagtttgccgaaatcggcgatgccggaggcggcgagcgttttgatcgggccggcggaaatgccgttgcagcggatgccctctttacccagacaggcggcggtaaagcggatgcctgcctcaaggctggcttttgccatacccatcacgttgtaattcggaatcgcgcgtaccgcgcccaagtagctaagggcgacgatggcggagttcctgccgcgcatcatcggacgggcggcttttgccaatgcgggcaggctgtatgcggaaatttcgtgtgcggtgttgaacgcttcgcggctgatgctgtcgaggaagtcgccgctcaaggcttctttcggcgcgaagccgatggaatgcaccaaaccgtccaagccatcccaatgtttgcctaagtcggcgaacacttggttgatttcgtcgtcgctggcgacatcgcagcggaatacgagttcggaatctaattccgccgccattttgcggacgcgctcttccagtttgtccacaacgtaggtaaacgccagttccgcgccctgttcgcggcaggctttggcgatgccgtaagcgatggaacgctcggaaatcatgccggtaatcagaatttttttgccttgcagaaaacccat

SEQ ID NO: 7340 - protein, 183 aa, Neisseria gonorrhoeae
SLGAQGINAVTAVNISDFAGNAGRQVGQQEGGSIPDFFDGNVAAQRVVGGDVSQEFAEIGDAGGGERFDRAGGNAVAADALFTQTGGGKADACLKAGFCHTHHVVIRNRAYRAQVAKGDDGGVPAAHHRTGGFCQCGQAVCGNFVCGVERFAADAVEEVAAQGFFRREADGMHQTVQAIPMFA

SEQ ID NO: 7341 - DNA, 195 bp, Neisseria gonorrhoeae
tctgccgaacaggttggcgatattttccatctgttcttcagtaaaaccgttttcgcccaatctggcggcaactgcccattcgcccgacaaaccgtggtccgcaccgagctgccgccatttttcgactttggcttcggctgtggttttttcgggcagcggtttgacgggaatcctgcttttggggacggtattcat

SEQ ID NO: 7342 - protein, 65 aa, Neisseria gonorrhoeae
SAEQVGDIFHLFFSKTVFAQSGGNCPFARQTVVRTELPPFFDFGFGCGFFGQRFDGNPAFGDGIH

SEQ ID NO: 7343 - DNA, 126 bp, Neisseria gonorrhoeae
ttggggctccgctgccgtcttacttccgcgccgaaacggcaaaatcaattcaaacttgactacgttctgcgcctgccggctgggaacaggcgcagggaaaatgctttgcggagtgcgtttttaata

SEQ ID NO: 7344 - protein, 42 aa, Neisseria gonorrhoeae
LGLRCRLTSAPKRQNQFKLDYVLRLPAGNRRRENALRSAFLI

SEQ ID NO: 7345 - DNA, 1014 bp, Neisseria gonorrhoeae
atcgatggaatagccgcgaagatactgtatccgttcgcgcgtcatccgcgtgtcgcattggagcttgaggtattcggcgtattcctgccggtctgcctgcgcggcggcttgtcggcagttgctgattttttcctgcgcccacttgcgctgttcgccgaccaactctttttgcacgtcggtatcgagtcctccccaaagtttggtaatttcggattccgcacgttggttttgtacgcgcgcctcttccacttcgccccgtgatacggtaacggtatcggcacgctcgacgtcgtcgggatgcaggatttcgggttcgggtgcgccttctgcggcttggggtacgcccgcatcgccgccggcggcattgtgttccaaaatgtcttcgggggtgggtttggacggttcttcttcacgggctttgccgctcaaaaccctgaccgcgtcttcttttgtcaccgccttgccgtctatcatcacgatgctcttcacgccgtaaggcagcaacgcggcagacagcgtttgcgtcgccataccgaccgtgttgtcgataaatgccgtccgagcgtctttggcgggcaggaagcggacggctgccgtcaatacgccgtctttaaactcgacattgccgcccgtcttctgctgcacgatgtctgccaaagacgtttccccatacagcagggggctgtttgcctcggcatcggcaagcgtttcagacggcacggtaatgttcaaatcggcgatacagaacgtgcgcccgccttcctgcgtttccgaagcgtgttccaaagaaaacgccaaaccgtaggcggcggcgataattttgtcggcatcgacaaactgcctgccgtcttcgcgcgcgaaagaacgcgcttcctgcgtgagcgtttcctgaatactgccgcgtatgtcctgcaacacggcggggttggcgcattccaacgccttgggcggttcttccctgccgcacgctgcaagcagcagggcaaacggcagcgcaatgagtttccgatacat

SEQ ID NO: 7346 - protein, 86 aa, Neisseria gonorrhoeae
IDGIAAKILYPFARHPRVALELEVFGVFLPVCLRGGLSAVADFFLRPLALFADQLFLHVGIESSPKFGNFGFRTLVLYARLFHFAP

SEQ ID NO: 7347 - DNA, 276 bp, Neisseria gonorrhoeae
atgccgtctgaagcggtttcgggcggcatatccttcggttttgccccgccgtccgatatgttaaacttgcgcccgtgccgaccgtcgtttgcgacggtttctttatttgatttgaacggaaaaaccatgtctccgccccttcctccgatgagcggaaaactgatggcggttttgatggcggtactggtcgcgctgatgccgttttccatcgatgcctacctgcccgcgattcccgaaatggcgcagccgctgaacgcggatatccaccgtatcgaa

SEQ ID NO: 7348 - protein, 92 aa, Neisseria gonorrhoeae
MPSEAVSGGISFGFAPPSDMLNLRPCRPSFATVSLFDLNGKTMSPPLPPMSGKLMAVLMAVLVALMPFSIDAYLPAIPEMAQPLNADIHRIE

SEQ ID NO: 7349 - DNA, 303 bp, Neisseria gonorrhoeae
ttgaaaatccgcagggatgcacgttccggggaaccgtgtgcggaagggtcggataaagaaggctataaagatcgatgcggcggtctgcctgccgcgttccgaacgctgcggtcggaaaaatgggcgccggcttcttcttgttatcgtgatgcctgtgttttcgggcggtttgcgttcggggcttggggctccgctgccgtcttacttccgcgccgaaacggcaaaatcaattcaaacttgactacgttctgcgcctgccggctgggaacaggcgcagggaaaatgctttgcggagtgcgtttt

SEQ ID NO: 7350 - protein, 101 aa, Neisseria gonorrhoeae
LKIRRDARSGEPCAEGSDKEGYKDRCGGLPAAFRTLRSEKWAPASSCYRDACVFGRFAFGAWGSAAVLLPRRNGKINSNLTTFCACRLGTGAGKMLCGVRF

SEQ ID NO: 7351 - DNA, 126 bp, Neisseria gonorrhoeae
ttgaataacattcttttcatgatcacctcgtggacgggcggcattcgggcgcgccggtccggttcggcattccgtaaggctgggtttccgatgtcttcggataaaaccggtaatcagtttttgagt

SEQ ID NO: 7352 - protein, 42 aa, Neisseria gonorrhoeae
LNNILFMITSWTGGIRARRSGSAFRKAGFPMSSDKTGNQFLS

SEQ ID NO: 7353 - DNA, 2763 bp, Neisseria gonorrhoeae
gtgatcatgaaaagaatgttattcaacgcaacgcaggccgaagagctgcgcgttgccatcgtcgacggacaaaacctgctggatttggacatcgaaacgctgggcaaagaacagcgcaaaggcaatatctacaaaggcatcattacccgcatcgagccgtcgctggaagcgtgtttcgtcgattacggaaccgaccgccacggctttttgccgtttaaagaagtatcgcgttcgtatttcctcggctacgaaggcgggcgcgcgcgcattcaggacgtgctcaaagaaggcatggaagtcatcgtccaagtcgaaaaagacgagcgcggcaacaaaggcgcggcgctgaccaccttcatcagcctcgccggacgctatctggtattgatgccgaacaatccgcgcggcggcggcgtatcccgccgtatcgaaggcgaagagcgtcaagaactcaaagccgcgatggcgcaactcgacattccgaacggcatgagcatcatcgcgcgtaccgccggcatcggccgcagcgcggaagagttggaatgggatttgaactacctcaaacaactctggcaggcaatcgaagaagcaggaaaagcgcatcacgacccctacctgctctttatggaaagctcgttgctcatccgcgccatccgcgactacttccgtcccgacatcggcgaaattttggtggacaatcaagaagtttacgaccaagttgccgagttcatgagctacgtcatgccgggcaacgcaggtcgtctgaaactctacgaagaccacacgccgctgttttcccgcttccaaatcgaacaccagatcgaaagcgcgttctcgcgcagcgtcagcctgccctccggcggcgcgatcgtcatcgaccacaccgaagccctcgtctccatcgacgtgaactccgcacgcgccacacgcggcgcggacatcgaagacaccgccttcaaaaccaatatggaagctgccgaagaagtcgcccgacaaatgcgcctgcgcgacttgggcggcttggtcgtcatcgacttcatcgacatggaaaaccccaaacaccagcgcgatgtggaaaacgtcctgcgcgacgcactcaaaaaagaccgcgcccgcgtacagatgggcaaactctcccgtttcggacttttggaattgagccgccaacgcctgaaacccgctttgggcgaaagcagccacgccgcctgtccgcgctgcgccggcaccggcgtgatccgcggcatcgaatccaccgccctgcacgttttgcgcatggttcaggaagaagcgatgaaggacaacaccggcgaagtgcgcgcccaagtgcccgtcgatgtcgccaccttcctgctgaacgaaaaacgcgccgagctgtttgcaatggaagagcgtttggatgtgaacgtcgtcctgattccgaacatccacctcgaaaatccgcactacgaaatcaaccgcatccgcaccgacgacgtagaagaagacggcgaaccgagctacaagcgcgttgccgagcctgaagaagacgaatccgccaaacctttcggcggcgaaaaagccaaagccgcccgccccgaacccgccgtcaaaggcgtgcgccacaccagccccgccccgactgccgcccccgagaaaaaaacctcctggtgggacagcttcaaagcatggctcaaacgcattttcggcggcagcgaaacccaagccgtacccgctgccgaaacctccgaaaaacgcagcacggcaaaccgcagcggcagccgcgccaacaaccgccgccaaaacccgcgccgcagcaaacgcgaaggcagcaaaatagaagtccgcgaagcggcgggcaaaactgccggacagaaagcgcgcgccgacaaagccgaaacgcgcaacaacggcaaccgccgccgcaacgaacgcggcgaccgtgccaccgaacgcgccaacgaagcggaaatccaaagccgcaacgtacagcctgccgcacccgttgcagatgccgcaccgcccgaaaccgaaggtcaaaccggaaaacgccgccgcaacggcagccgcaacgaacgtggccaaaccgcaccggaaaccgccgccgttgccgaaacagccgttcagacagcggaaaacacgccgcccgaaccgtataccgcagaagacaaaggcagcaagcccaaatccgaacgcaaccgccgcgaacgcgacagccgcgatgccaaagaacgccgcgaacgcaacaatcagcgcgaccgccgtcaaaacggcaaaaaacgcaatatcccgtctgccgccaaaatcgagcagtacctgaatattcacgacaccgccgacaaagtccgttccgccgccgcgcacgttttcggcgaaaccgacgcaaacgcgccgattaccgtcagcattgccgatccgctcatcgccacacccgttcagacggcatcttccgccgtttcaaacggcgacgcactgatttatgatgcggcggaaaaaatccgccgtgccgccgccgacatcctgcccgaaggcgcggcaccgaaagccgcagcacaggaaatgccgtctgaaaccgcaacctttacggctgcggcggaacaggcacgggaaaccgcacaaaccggcggactcgtcctgatcgaaaccgaccctgccgcattgaaggcatgggcggcacaacccgaagtccaagccggacgcggtttgcgccgttccgaacagccaaaaccgtctgaagccgcaaccgtccctgccgaagaaatgatccaagtcgaaacccggcaaggc

SEQ ID NO: 7354 - protein, 921 aa, Neisseria gonorrhoeae
VIMKRMLFNATQAEELRVAIVDGQNLLDLDIETLGKEQRKGNIYKGIITRIEPSLEACFVDYGTDRHGFLPFKEVSRSYFLGYEGGRARIQDVLKEGMEVIVQVEKDERGNKGAALTTFISLAGRYLVLMPNNPRGGGVSRRIEGEERQELKAAMAQLDIPNGMSIIARTAGIGRSAEELEWDLNYLKQLWQAIEEAGKAHHDPYLLFMESSLLIRAIRDYFRPDIGEILVDNQEVYDQVAEFMSYVMPGNAGRLKLYEDHTPLFSRFQIEHQIESAFSRSVSLPSGGAIVIDHTEALVSIDVNSARATRGADIEDTAFKTNMEAAEEVARQMRLRDLGGLVVIDFIDMENPKHQRDVENVLRDALKKDRARVQMGKLSRFGLLELSRQRLKPALGESSHAACPRCAGTGVIRGIESTALHVLRMVQEEAMKDNTGEVRAQVPVDVATFLLNEKRAELFAMEERLDVNVVLIPNIHLENPHYEINRIRTDDVEEDGEPSYKRVAEPEEDESAKPFGGEKAKAARPEPAVKGVRHTSPAPTAAPEKKTSWWDSFKAWLKRIFGGSETQAVPAAETSEKRSTANRSGSRANNRRQNPRRSKREGSKIEVREAAGKTAGQKARADKAETRNNGNRRRNERGDRATERANEAEIQSRNVQPAAPVADAAPPETEGQTGKRRRNGSRNERGQTAPETAAVAETAVQTAENTPPEPYTAEDKGSKPKSERNRRERDSRDAKERRERNNQRDRRQNGKKRNIPSAAKIEQYLNIHDTADKVRSAAAHVFGETDANAPITVSIADPLIATPVQTASSAVSNGDALIYDAAEKIRRAAADILPEGAAPKAAAQEMPSETATFTAAAEQARETAQTGGLVLIETDPAALKAWAAQPEVQAGRGLRRSEQPKPSEAATVPAEEMIQVETRQG

SEQ ID NO: 7355 - DNA, 903 bp, Neisseria gonorrhoeae
ttgtatgaccatctgactttaccactcactatgttttaccaaatccttgccctgattatctggggcagctcgtttattgccgccaaatatgtctatggcggcatcgatcccgcattgatggtcggcgtgcgcctgctgattgccgcgctgcctgcactgcccgcctgccgccgtcatgtcggcaagattccgcgtgaggaatggaagccgttgctgattgtgtcgttcgtcaactatgtgctgaccctgctgcttcagtttgtcgggttgaaatacacttccgccgccagcgcatcggtcattgtcggactcgagccgctgctgatggtgtttgtcggacactttttcttcaacgacaaagcgcgtgcctaccactggatatgcggcgcggcggcatttgccggtgtcgcgctgctgatggcgggcggtgcggaagagggcggcgaagtcggctggttcggctgcctgctggtgttgttggcgggcgcgggcttttgtgccgctatgcgtccgacgcaaaggctgattgcccgcatcggcgcaccggcattcacatctgtttccattgccgccgcatcgttgatgtgcctgccgttttcgcttgctttggcgcaaagttataccgtggactggagcgtcgggatggtattgtcgctgttgtatttgggtttggggtgcggctggtacgcctattggctgtggaacaaggggatgagccgtgttcctgccaacgcgtcgggactgttgatttcgctcgaacccgtcgtcggcgtgctgttggcggttttgattttgggcgaacatttatcgcccgtgtccgccttgggcgtgtttgtcgtcatcgccgccactttcgccgccggccggctgtcgcgcagggacgcgcaaaacggcaatgccgtc

SEQ ID NO: 7356 - protein, 301 aa, Neisseria gonorrhoeae
LYDHLTLPLTMFYQILALIIWGSSFIAAKYVYGGIDPALMVGVRLLIAALPALPACRRHVGKIPREEWKPLLIVSFVNYVLTLLLQFVGLKYTSAASASVIVGLEPLLMVFVGHFFFNDKARAYHWICGAAAFAGVALLMAGGAEEGGEVGWFGCLLVLLAGAGFCAAMRPTQRLIARIGAPAFTSVSIAAASLMCLPFSLALAQSYTVDWSVGMVLSLLYLGLGCGWYAYWLWNKGMSRVPANASGLLISLEPVVGVLLAVLILGEHLSPVSALGVFVVIAATFAAGRLSRRDAQNGNAV

SEQ ID NO: 7357 - DNA, 225 bp, Neisseria gonorrhoeae
atggtcatacaaaagtatagcggattaacaaaaatcaggacaagaaggaatgcccgaaccgtcattcccgccacttttcgtcattcccgcgaaagcgggaatctaggacgcagggttaagaaaacctacatcccgtcattccctcaaaaacagaaaaccaaaatcagaaacctaaaatcccgtcattcccgcgaaagcgggaatctagaatctcggactttcaga

SEQ ID NO: 7358 - protein, 75 aa, Neisseria gonorrhoeae
MVIQKYSGLTKIRTRRNARTVIPATFRHSRESGNLGRRVKKTYIPSFPQKQKTKIRNLKSRHSRESGNLESRTFR

SEQ ID NO: 7359 - DNA, 1302 bp, Neisseria gonorrhoeae
gcctttaaagaaattcacaaaaccggtgagaatcgcggcattaatcaaatcgacaaagaacgcgccgaccataggcacaatcaaaaacgccttatgtgacgcgccgaaagtatgcgtgacggactgcatatttgccaccgccgtcggcgttgcgcccaaaccgaaaccgcagtggccggcagccaatactgcggcatcatagtcgcgccccataaagacataggtaacaaaagtcgcgtacaaaaccatcactgcggtttgtactgcaagaatcacggttacagaccccgccaaaccggtcagctcccacagtttcaaattcagcaacgccattgccaagaaaagcgaaagcgaagcattgccgaacacatcgatggcacggtcgaacatattgaccttgaatgcggcggtaaggatgttgcggataaccacgccgccaaacagacaccacacgaatttgggcaggtcgaacaggtattctttgtcgaaaccgtccataatctcggcaaacgccagacacgcggcaaacatggcaagcgtttcaacggcagattccgccgtaatcaggcgggtgcgttttgcctgctcgaacacgtcgtccgcgttgtcgtcctgatcctgttttgtgttttcaaccggtttgcggcccattttgttgatcaggcggcgcgcaaccggccctccgatcaggccgccgaacaccagcccgaaagtaaccgaagcaatacccaaaccggttgcgccgaccaagccgtattgcgtttcaaaattaggtccccacgcacctgacgtgccgtgtccgcccgtcagcgacaccgaaccggtaatcagaccgatgagcgggtccaaacccaaagccgtagccagtccgaccccgacaaagttttgcaccaagataaatccgcccacaatcgcggtaaaaaccaccagcggcaaaccgcccgccttcaaacgggaaaaatccgcgctcaagccgatggacgtgaagaaaatcagcataaacgcattttgcagcggtttctcaaatttgaagctcacgccgtacgcctcgtgcagcgcaaacaggataatcgcggcaatcagcccgcccgccacgggttcggggatgttaaaatcacgcaagattttgattttcttaaccaaaaccttgccgaccaacaaaaccaaagtggcggcaatcaaggtgtaataactgttaaacgcccattccatatcgtttgacctcctaaaatgtttttctttatatccgcccgaaggggacgcaagcgcgaagatattaggggaatagttaaggcttgtcaa

SEQ ID NO: 7360 - protein, 32 aa, Neisseria gonorrhoeae
AFKEIHKTGENRGINQIDKERADHRHNQKRLM

SEQ ID NO: 7361 - DNA, 105 bp, Neisseria gonorrhoeae
ttgactcgccttgccgtactatctgtactgtctgtggcttcgtcgccttgtcctgatttaaatttaatccactatacaactattttttacaaacaaaatgccgtc

SEQ ID NO: 7362 - protein, 35 aa, Neisseria gonorrhoeae
LTRLAVLSVLSVASSPCPDLNLIHYTTIFYKQNAV

SEQ ID NO: 7363 - DNA, 126 bp, Neisseria gonorrhoeae
ttgaccttcggccaaaaggatggcttcggaaacttgcgcgcgggcgggaatccggaccttggaacaacggcaatattcaaagattatctgaaagtccgagattctagattcccgctttcgcgggaa

SEQ ID NO: 7364 - protein, 42 aa, Neisseria gonorrhoeae
LTFGQKDGFGNLRAGGNPDLGTTAIFKDYLKVRDSRFPLSRE

SEQ ID NO: 7365 - DNA, 1008 bp, Neisseria gonorrhoeae
ttgtttggagcaaacacgatgaaacagcctgtttttgccgttacttccggcgagcctgccggcatcggccccgatatttgtttggacttggcgtttgcacgcctgccctgccgctgcgcggtattgggcgacaaacacctgttgcgcgcgcgcgccgaagccttgggcaaaagcgtcgtcctgcgcgacttcgatccggaatcaggcggcgcgcacggagaaggcgggctggaagtgctgcacatccctgccgccgaagcggttgaggcagggtggctcaatcccgccaacgccgcctatgtgctgcaacttttggacgccgcgctcgcaggcatttcagacggcattttcgacggcatcgttaccgcgccgctgcacaaaggcatcatcaacgccgcgcgcgcaagcacaggttttttcagcggacacaccgaatatctggcggaaaaaagcggcacggggcaggtcgtgatgatgcttgccggcaaaggcctgcgcgtcgccctcgtaacgacccacctgccgctgaaagacgttgccgccgccatcacgcaaccgctgattgaaagcgtcgcacgcattttgcatcacgacttaaaacacaaattcggcatcaaaaatcccaaaatcctagtcgccgggctcaatccccacgccggcgaaggcggacacctcggacacgaagaaaccgacaccattatccccgcgctcgaaaacctgcgccgcgaagggataaacctcgccggcccgtatccggcggacacattgttccaaccgtttatgctcgaaggtgcggatgccgtattggcgatgtaccacgaccaagggctgcccgtgttgaaataccacagcttcgggcagggcgtgaacatcacgctggggctgccctttatccgcacctccgtcgatcacggcaccgcgctcgatttggcggcaaccggcagggcggactccggcagcctgataactgccgtggagaccgccgtcgagatggcgcgcggcagcctt

SEQ ID NO: 7366 - protein, 336 aa, Neisseria gonorrhoeae
LFGANTMKQPVFAVTSGEPAGIGPDICLDLAFARLPCRCAVLGDKHLLRARAEALGKSVVLRDFDPESGGAHGEGGLEVLHIPAAEAVEAGWLNPANAAYVLQLLDAALAGISDGIFDGIVTAPLHKGIINAARASTGFFSGHTEYLAEKSGTGQVVMMLAGKGLRVALVTTHLPLKDVAAAITQPLIESVARILHHDLKHKFGIKNPKILVAGLNPHAGEGGHLGHEETDTIIPALENLRREGINLAGPYPADTLFQPFMLEGADAVLAMYHDQGLPVLKYHSFGQGVNITLGLPFIRTSVDHGTALDLAATGRADSGSLITAVETAVEMARGSL

SEQ ID NO: 7367 - DNA, 315 bp, Neisseria gonorrhoeae; identical to SEQ ID NO: 219

SEQ ID NO: 7368 - protein, 105 aa, Neisseria gonorrhoeae; identical to SEQ ID NO: 220

SEQ ID NO: 7369 - DNA, 384 bp, Neisseria gonorrhoeae
ttggccgaaggtcaaaaatcagccgtcaccgagtattacctgaatcacggcacatggccggaaaacaacacttctgccggcgtggcatcctccgccaccgacatcaaaggcaaatatgttcaaagcgttacggtcgcaaacggcgtcgttaccgccgaaatgaaatcagacggcgtaaacaaagaaatccaaggcaaaagactctccctgtgggccaggcgtgaagccggttcggtaaaatggttctgcggacagccggttacgcgcgccaaagccaaagacgccgacgacgttaccgacgacgccggcaccgacaacggcggcaaaggcaaaatcgacaccaagcacctgccgtcaacctgccgcgataaatcaactgccaaa

SEQ ID NO: 7370 - protein, 128 aa, Neisseria gonorrhoeae
LAEGQKSAVTEYYLNHGTWPENNTSAGVASSATDIKGKYVQSVTVANGVVTAEMKSDGVNKEIQGKRLSLWARREAGSVKWFCGQPVTRAKAKDADDVTDDAGTDNGGKGKIDTKHLPSTCRDKSTAK

SEQ ID NO: 7371 - DNA, 855 bp, Neisseria gonorrhoeae
aatatgaaattcttggtcttcttgtagcataagttctcgatgatatgccaagtaagatttacgtttgtcgttgagcagattgttatctagcttcacatcacaccaacgtcgccaaacatcatctgataaccgcttagatttcaccatatttccttcatcatcaaacgaaatatatttcaaatcaaataggctatccaaggtacgacttaatagcaagccgttatttgggtcgtatgcttcggtatcatccgacaggatgaaaggcttaatatgactggcaatcaatacaggataggcaagtttttccagcatacatttcacattaccgtaatgttcttcactttcttcttgaagttggtttttgtataggcgatgtaaataagggtcgcgtttccttacagtaatttcatccaaattaccaaaaatacgttgggcatcctcagcaaaatataagtcatcacctactcgttttaagtcgtctaatttgtctaataggttccataaataacttatttgattgtattttcgttcaataaatcctgattctattccctgttgaaaataatcattcaattctgtttcggttagataatcttgttgaaaggtttttaagtctactaacatcatggcggcaatttcttttttatttagcttgccttgtggatgctcgaccagcgttttaatcaggaaatttatttgtcgaatattagagttttcagttactgaacgctgaaagccagagtgcgtatatacgattttggaaagtagggtttgtcgttttcggttagtacgagcttgtacataatctcgtgataaaggtgtatagcttgataaaaacggttctataaatcccat

SEQ ID NO: 7372 - protein, 8 aa, Neisseria gonorrhoeae
NMKFLVFL

SEQ ID NO: 7373 - DNA, 96 bp, Neisseria gonorrhoeae
ttggctgattattactcatctctgtctccaagaatattcgataccaatattctgtttttgtatttaagtaatatctatcattcatgtattttctac

SEQ ID NO: 7374 - protein, 32 aa, Neisseria gonorrhoeae
LADYYSSLSPRIFDTNILFLYLSNIYHSCIFY

SEQ ID NO: 7375 - DNA, 1425 bp, Neisseria gonorrhoeae; identical to SEQ ID NO: 5381

SEQ ID NO: 7376 - protein, 475 aa, Neisseria gonorrhoeae; identical to SEQ ID NO: 5382

SEQ ID NO: 7377 - DNA, 171 bp, Neisseria gonorrhoeae
gtgtttaaacgggtggcaatgaggcacatgcagggccttgaagcgcaatcgatatattatttccaccggaacggacgaccccgcccgccttgcaaacccttaaaagacaagccgcccgggttgatccgggcggccgtgggaaatcacttaccgtttgatttatttaaaatt

SEQ ID NO: 7378 - protein, 57 aa, Neisseria gonorrhoeae
VFKRVAMRHMQGLEAQSIYYFHRNGRPRPPCKPLKDKPPGLIRAAVGNHLPFDLFKI

SEQ ID NO: 7379 - DNA, 690 bp, Neisseria gonorrhoeae
atgagcgaaatcctcaggcagcccagcgttctgcttttcctcacgcttgccgtgtacgcgcttgcgattatcgtgcgcacgcgcacgggcaatatcttctgcaaccccgtactcgtcagcactatcgtgctgattgcctacctgaaaatcctcggtatcgattatgcggtgtaccacaacgccgcgcaattcattgattttcggctgaaacccgccgtcgtcgtgcttgccgtgccgctctaccaaaaccgccgtaaaatcttcaaccagtggctgcccgtcatcgtttcgcagcttgcgggcagcgttacgggcattgttacggggatgtattttgccaagtggctgggcgcggaacgcgaagtcgtcctcccgctcgcgtccaaatctgttaccaaccccatcgccatcgaaatcacccgctccatcggcggcattcccgccattaccgccgccaccgtcatcattgccggtctggtcggacagattgccggttacaaaatgttgaagaacacggtcgtcatgccctcgtccgtgggtatgtcgctcggcacggcttcgcacgcgatgggcattgccgcctcgctcgaacgcagccgccgcatggcggcatacgcggggatggggctgacgttcaacggcgtgctgaccgcgctgattgcgccgctgcttatccccgttttggggttc

SEQ ID NO: 7380 - protein, 230 aa, Neisseria gonorrhoeae
MSEILRQPSVLLFLTLAVYALAIIVRTRTGNIFCNPVLVSTIVLIAYLKILGIDYAVYHNAAQFIDFRLKPAVVVLAVPLYQNRRKIFNQWLPVIVSQLAGSVTGIVTGMYFAKWLGAEREVVLPLASKSVTNPIAIEITRSIGGIPAITAATVIIAGLVGQIAGYKMLKNTVVMPSSVGMSLGTASHAMGIAASLERSRRMAAYAGMGLTFNGVLTALIAPLLIPVLGF

SEQ ID NO: 7381 - DNA, 153 bp, Neisseria gonorrhoeae
gtgcctcattgccacccgtttaaacacggtttttatctgacaggcgcgcaatccgccccctcatttgttaatccgccatattgtattgaaacaccgcccggaacccgatataatccgcccttcaacatcagtgaaaatctttttttaaccggt

SEQ ID NO: 7382 - protein, 51 aa, Neisseria gonorrhoeae
VPHCHPFKHGFYLTGAQSAPSFVNPPYCIETPPGTRYNPPFNISENLFLTG

SEQ ID NO: 7383 - DNA, 261 bp, Neisseria gonorrhoeae
caaattgattaatagcttacgaaccgaggccaaattcatggccttgcttgttctctgcgaagccataacggaatcttgggcaatgttttgctgcaatgcttcatatagttcgttgctgtatggctggtcttgattcgcatcaataaagtcaagacaaatattgagtgcagtacaaaatttttgatcgttataatttgtaaaggcattggtaaacgcccaataatcttcataaatttggctgtttggctgattattactcat

SEQ ID NO: 7384 - protein, 30 aa, Neisseria gonorrhoeae
LTNRGQIHGLACSLRSHNGILGNVLLQCFI

SEQ ID NO: 7385 - DNA, 834 bp, Neisseria gonorrhoeae
atgaatccagcccgcaaaaaaccttctcttctcttctcttctcttctcttctcttctcttctcttctcttctcttctcttctcttcggcagcgcaggcggcaagtgaaggcaatggccgcggcccgtatgtgcaggcggatttagcctacgccgccgaacgcattacccacgattatccggaaccaaccgctccaggcaaaaacaaaataagcacggtaagcgattatttcagaaacatccgtacgcattccatccaccccagggtgtcggtcggctacgacttcggcggctggcgcatcgccgcggattatgcccgttacaggaaatggcacaacaataaatattccgtgaacataaaagagttggaaagaaagaataataaaacttttggcggcaaccagcttaacataaaataccaaaagacggaacatcaggaaaacggcacattccacgccgtttcttctctcggcttgtccgccgtttacgatttcaaactcaacgacaaattcaaaccctatatcggtgcgcgcgtcgcctacggacacgtcagacacagcatcgattcgactaaaaaaataacaggtactcttaccgcctaccctagtgatgctgacgcagcagttacggtttatcctgacggacatccgcaaaaaaacacctatcaaaaaagcaacagcagccgccgcttgggcttcggcgcgatggcgggcgtgggcatagacgtcgcgcccggcctgaccttggacgccggctaccgctaccacaactggggacgcttggaaaacacccgcttcaaaacccacgaagcctcgttgggcatgcgctaccgcttc

SEQ ID NO: 7386 - protein, 278 aa, Neisseria gonorrhoeae
MNPARKKPSLLFSSLLFSSLLFSSLLFSSAAQAASEGNGRGPYVQADLAYAAERITHDYPEPTAPGKNKISTVSDYFRNIRTHSIHPRVSVGYDFGGWRIAADYARYRKWHNNKYSVNIKELERKNNKTFGGNQLNIKYQKTEHQENGTFHAVSSLGLSAVYDFKLNDKFKPYIGARVAYGHVRHSIDSTKKITGTLTAYPSDADAAVTVYPDGHPQKNTYQKSNSSRRLGFGAMAGVGIDVAPGLTLDAGYRYHNWGRLENTRFKTHEASLGMRYRF

SEQ ID NO: 7387 - DNA, 1011 bp, Neisseria gonorrhoeae
tgtattttctactaaaaacagaatttccttatggctttgcttcttttcttttcctgtaaccttataaacgtgaggcgtttccaagatttgtacatttcgcccatttttacctaacatttcttctaattcatctcggtttggatatgaagcattgttgtagcttaacagccaatatttaaatggtttcaaatgattgattacccttttaaataattcgacagcctgctttttatccatgaaatgattggcaaatggtttgggtatggatgatgtaatgtaactgtccaataatccgtaaaagccaaaataattgttcatcgtgcctgtgtaaggtgggtctaaatagacggcatcagcttgtatattaggtaataaatcaaatatatcttgattaaaggcgtgatgccgccagccattattgaaaacagcttggttatagtcatccaaattttgcagaaaatgactttgaaaactttcattgtggtaggcgcgtcgacggccatatttagcataactgtattcttcatcacgcagttgtttaactttttcccaaggaattgtgaatcgtgaatagggcattttacgtatcatggcgcgacgcattaaagtaaacgccaaagcacgtttatactggttattcagcttccctatatttttacggtacaaatcaagttgttggcattcatcgtgaaaatagaatttttcggaataacgctgactcataaaaccggcatgcgggctgcctgaaaaaatcattgcgacatcatcgtcatttaatgtttcatggttgttttctattaatgctaaagcaatttggtaattaattgccaaaatatcgttagtaatcacacgatagccgcgttttttggcttcgtaggcaaaggaacagcctccactaaatacatctgcaactgtatctacatcagacggaagctggtcacaaatccaggaagctattttctctttattaccgatatagttaattttcggatatttcttattcattttcac

SEQ ID NO: 7388 - protein, 4 aa, Neisseria gonorrhoeae
CIFY

SEQ ID NO: 7389 - DNA, 171 bp, Neisseria gonorrhoeae
atgtgggtcatgtgtgtattgcctatcggtttttcagacggcattccaagcaggatgccgtctgaaaaacgaaacggattcaaaagtaaagggttgggattgtacgcctgttcgccctgtttttacagtgcgcggaaagggaaaagccgcttcgcggggaagcggctccgg

SEQ ID NO: 7390 - protein, 57 aa, Neisseria gonorrhoeae
MWVMCVLPIGFSDGIPSRMPSEKRNGFKSKGLGLYACSPCFYSARKGKSRFAGKRLR

SEQ ID NO: 7391 - DNA, 999 bp, Neisseria gonorrhoeae
ttcattttcactcatttttaaaatactttcagcaatagcttttgccaataaaggcggcacggcgttaccaacctgctgctgctgggcaattttgctgccgcaaaaaataaaattatcagggaaagattgtaaggcagctaattcacgaacggttaaagcccgattctgttcatagtgaaaaactttgcgcatatctcctgtaatacaaacggctggtttgttgctgttgtaacggatgtatttacggatatcacctgttttcggacgtaatggttcaggaatatcgttacggttacctccatttttaacaaatgccattttttctaacatttgtgccgaatgattcatagcttcatgatttgcaacgtgtggattgctttcgccagcagccagttttggaaaatgtcctattgctgatccaacagtctgatgggaaatctgcaaaggttcgggaaaggaaattttgcctttatccctcctcccgataaatatcactcggctacgtatctgaggaacaccgaaatcggctgcactcagtatcttacattccaccgaataaccgatattctgaaatgcttgaataatctcaatacgtgttttacctgaattgtgtgtatagagtcgcgctacattttccataacaaaaaaatatggttggacaattttaactattcggacaaactctttaaataaatggttgcgtgggtcatctgtaaatgtccgtccaatctttcctgccatactaaaaccttgacaaggtggtcctccaataaccaaatcaactgattgtccgttaagacaattggttaaatcttgttcggttagtgtggttaaatctttttgcagtaattgatgacgggggaagttggtacggtaagtctgacaataatcagactccatttcaacagaaagcaattgttggaatccggcttgttcaaaacccaaggataggcctcctgctcctgagaaaaggtcaatataggtaagtggtgtgtgcat

SEQ ID NO: 7392 - protein, 6 aa, Neisseria gonorrhoeae
FIFTHF

SEQ ID NO: 7393 - DNA, 135 bp, Neisseria gonorrhoeae
gtgcggacaggtccggattcccgcctgcgcgggaatgacgaatttcgagattgcggtgttgtcgggaatgacggttcgggtattttactgcgcccgccccgcgcctgtaaacggcgggcgattaaaaatgccgtc

SEQ ID NO: 7394 - protein, 45 aa, Neisseria gonorrhoeae
VRTGPDSRLRGNDEFRDCGVVGNDGSGILLRPPRACKRRAIKNAV

SEQ ID NO: 7395 - DNA, 1893 bp, Neisseria gonorrhoeae; identical to SEQ ID NO: 5451

SEQ ID NO: 7396 - protein, 631 aa, Neisseria gonorrhoeae; identical to SEQ ID NO: 5452

SEQ ID NO: 7397 - DNA, 114 bp, Neisseria gonorrhoeae
ttggagtcgatgaatcggtgggcttcagtccgccattcccatcaatccaacatttctaccgttttcatcgaatccatcgaatccgcctctttcgaccacccggccctatgcaac

SEQ ID NO: 7398 - protein, 38 aa, Neisseria gonorrhoeae
LESMNRWASVRHSHQSNISTVFIESIESASFDHPALCN

SEQ ID NO: 7399 - DNA, 939 bp, Neisseria gonorrhoeae
atgcaactgaaccgtcattcccacggaagtgggaatctaggacgcggggtttgggcaaccgttttatccgataagtttccgtgcggacaggtccggattcccgcctgcgcgggaatgacgaatttcgagattgcggtgttgtcgggaatgacggttcgggtattttactgcgcccgccccgcgcctgtaaacggcgggcgattaaaaatgccgtctgaaggttcagacggcatcggtatcggggaatcagaagcggtagcgcatgcccaacgaggcttcgtgggttttgaagcgggtgttttccaagcgtccccagttgtggtagcggtagccggcgtccaaggtcaggccgggcgcgacgtctatgcccacgcccgccatcgcgccgaagcccaagcggcggctgctgttgcttttttgataggtgtttttttgcggatgtccgtcaggataaaccgtaactgctgcgtcagcatcactagggtaggcggtaagagtacctgttatttttttagtcgaatcgatgctgtgtctgacgtgtccgtaggcgacgcgcgcaccgatatagggtttgaatttgtcgttgagtttgaaatcgtaaacggcggacaagccgagagaagaaacggcgtggaatgtgccgttttcctgatgttccgtcttttggtattttatgttaagctggttgccgccaaaagttttattattctttctttccaactcttttatgttcacggaatatttattgttgtgccatttcctgtaacgggcataatccgcggcgatgcgccagccgccgaagtcgtagccgaccgacaccctggggtggatggaatgcgtacggatgtttctgaaataatcgcttaccgtgcttattttgtttttgcctggagcggttggttccggataatcgtgggtaatgcgttcggcggcgtaggc

SEQ ID NO: 7400 - protein, 313 aa, Neisseria gonorrhoeae
MQLNRHSHGSGNLGRGVWATVLSDKFPCGQVRIPACAGMTNFEIAVLSGMTVRVFYCARPAPVNGGRLKMPSEGSDGIGIGESEAVAHAQRGFVGFEAGVFQASPVVVAVAGVQGQAGRDVYAHARHRAEAQAAAAVAFLIGVFLRMSVRINRNCCVSITRVGGKSTCYFFSRIDAVSDVSVGDARTDIGFEFVVEFEIVNGGQAERRNGVECAVFLMFRLLVFYVKLVAAKSFIILSFQLFYVHGIFIVVPFPVTGIIRGDAPAAEVVADRHPGVDGMRTDVSEIIAYRAYFVFAWSGWFRIIVGNAFGGVG

SEQ ID NO: 7401 - DNA, 99 bp, Neisseria gonorrhoeae
ttgaaattcgtcattcccgataacaccgcaatctcgaaacccgtcattcccgcgcaggcgggaatccagacccccgacgcggcgggaatctatcggaaa

SEQ ID NO: 7402 - protein, 33 aa, Neisseria gonorrhoeae
LKFVIPDNTAISKPVIPAQAGIQTPDAAGIYRK

SEQ ID NO: 7403 - DNA, 636 bp, Neisseria gonorrhoeae; identical to SEQ ID NO: 5485

SEQ ID NO: 7404 - protein, 212 aa, Neisseria gonorrhoeae; identical to SEQ ID NO: 5486

SEQ ID NO: 7405 - DNA, 2436 bp, Neisseria gonorrhoeae
ccgcttcagcttcgcaaacgcatccgccatcgccgaattggtcggggcgcggtcgttgcgttggggtttgcggccggctgtccgttcgcggctgcggttttcagacggcattttatgttttgcgccgcccggttcgtcatccaagcgcatggtcagcgcgatgcgtttgcgtgcggcatcgacttccagcactttcactttcaccacgtcgccggctttcaccacttcgcgcgggtcttggacgaacttattagacagggcggagatgtgcaccaagccgtcctgatggacgccgatgtccacgaacgcgccgaagttggcgacgttggagaccacgccctcgagtatcatgccgacttgcaagtcgctgatttcgtggatgccttcggcaaacgatgccgtctgaaacgcaccgcgcgggtcgcggccgggtttttccagctcggacaggatgtccaaaatagtcggcagaccgaagcgttcgtcggtgaagtcggatgctttgatttgcttcacacgctcgcggttgccgatgagttcggcggcggtaatgccttgttgcgccagcattttggcgacgacgggataggcttcggggtggacggcgctcgcgtccagcggctctttgccgccgttaatccgcaaaaagcctgctgcttgctcgaaggttttttcgcccaagcgcggtacttttagcaatttttttcggctgtcgaacgcgccgttttcatcacggtaggcgacgatgttttgggcaagggtttgatttaaaccggaaatccgcgccaagagcggggcggaggcggtgttcgcgtccacgccgacggcgttcacgcagtcttcgaccaccgcgtccagcgatttggcgagccggctttggttcacgtcgtgctgatactgccccacgccgatggatttggggtcgattttgaccaactcggcaagcgggtcttgcagcctgcgggcgatggacactgcgccgcgcagggaaacatctaagtcgggaaactcgcgcgccgccagttcggacgcagaataaatcgacgcgccggcttcggaaacgacgattttgtgcaggctgctttcgggcattccgcgcaccagttcgcccgcgattttgtcggtttcgcggctggcggtgccgttgccgatggcgatgagcttcacaccgtgttgtttaatcaggcgcgacaacgttgccaacatattgttttcttgatgcaaatagacaatgaccgtatccagcagtttgcccgtgtcgtccaccacggcgcatttcacgccgttgcggtagccggggtcgagtcccaaagtggtcagccgcccggcgggcgcggcgagcagcaagtctttgagattgcgggcgaacacggtaatcgcgtcagtgtcggcagcttctttcaaacgattgagagcttcgagttccagcgacaaaaagattttcgcgcgccaagtcaggcgcacggtgtcgcgcagccatttgtggccgtctgaaaccttgaagcggcgggcgatgatttgctcgtattcgctttgctgcgtaatcggcgtgtcgtcgggctggtatttgagcgcgatgttcaacacgccttcgttgcgaccgcgcaaaaccgccagcgcgcggtggctgggcatggcgcgcacgggttcgcggcggtcgaaataatcgctgaatttttcgccttcggtttctttgccttcaacgacttgcgtgtggatttcggcttcgttccacagcttgtcgcgcagcgtgccgatgagttccgcgtcttcggcaaactgctccatcagaatcgcgcgcgcgccatccagcgcggctttggcgtcggggatgttttcgttcaggtagccttgcgcggcggcttccacgtcctgcggctgttcggcaagcaacacgtccgccagcggctgcaaaccgtgttcgtgcgcgatttgcgctttggtgcggcgtttgggtttgtagggcaggtacaggtcttccaacgcggttttgttgtcggcggcttcgatttgcgccctgaggtcgtctgaaagcttgccttgctcttcaatgctttttaacacaacggccttgcgctcttccaactcgcgcaggtattgcagccgctcggcaagctggcgcagctgcgtatcgtccagcccgcccgtggcttctttacggtaacgcgcgataaaggggacggtcgcgccgtcgtccaaaagctcgatagcggcattgatttgcacggtagtggcggagagttcttgggagaggattcgggtgatgttcataaattgcctccgtgatgccgtctgaacagccgacggcgcaatgtgggtaatcgtttggaaaagatgaagataatactgatatactttgcccgatacaatctgaaaggaatgtttgtttatgaccgtcctgattaccggcggcaccggctttatcggttcgcacac

SEQ ID NO: 7406 - protein, 231 aa, Neisseria gonorrhoeae
PLQLRKRIRHRRIGRGAVVALGFAAGCPFAAAVFRRHFMFCAARFVIQAHGQRDAFACGIDFQHFHFHHVAGFHHFARVLDELIRQGGDVHQAVLMDADVHERAEVGDVGDHALEYHADLQVADFVDAFGKRCRLKRTARVAAGFFQLGQDVQNSRQTEAFVGEVGCFDLLHTLAVADEFGGGNALLRQHFGDDGIGFGVDGARVQRLFAAVNPQKACCLLEGFFAQARYF

SEQ ID NO: 7407 - DNA, 1020 bp, Neisseria gonorrhoeae
ttgtttatgaccgtcctgattaccggcggcaccggctttatcggttcgcacaccgccgtctcgctcgtccaatccggttacgatgccgtgattttggataatctgtgcaactcgtctgccgccgtcctcccgcgccttcggcaaattaccggcagaaacataccgttttatcagggcgacatccgcgactgtcagattttgaggcagattttttcagaacatgaaatcgaatccgtcatccattttgccggtttgaaggcagtgggggaaagcgttgccgagccgacaaaatattacggcaacaatgtttacggcagcctggtgctggcggaagaaatggcgcgcgcgggcgtgttgaaaatcgtattcagctcgtcggcaaccgtttacggcgatgcggaaaaagtcccctatacggaagatatgcgcccgggcgataccgctaatccttacggtgcgtccaaagcgatggtggagcggatgttgaccgacatccaaaaagccgatccgcgttggagcgtgattttgttgcgctatttcaacccgatcggcgcgcacgaaagcggacttatcggcgaacagcccaacggcgttcccaacaatcttttgccctatatctgtcaagtggcttcgggcaggctgccgcaactgtcggtattcggcggcgactatccgacccccgacggtacgggaatgcgcgactacatccatgtgatggatttggcagaagggcatatcgcggcaatgaaggcgaaaggcggcgttgccggcgtacatttgttcaacttgggttcgggacgcgcctattccgttttggaaatcatccgcgcctttgaggccgcatccggtttgcacattccttaccgaatccaaccccgccgcgccggcgacttggcgtgttcctatgccgacccgtcccataccaaacaacaaaccggctgggaaaccaaacgcggcttgcagcaaatgatggaagattcgtggcgttgggtcagccgcaaccccggcagatatggggat

SEQ ID NO: 7408 - protein, 340 aa, Neisseria gonorrhoeae
LFMTVLITGGTGFIGSHTAVSLVQSGYDAVILDNLCNSSAAVLPRLRQITGRNIPFYQGDIRDCQILRQIFSEHEIESVIHFAGLKAVGESVAEPTKYYGNNVYGSLVLAEEMARAGVLKIVFSSSATVYGDAEKVPYTEDMRPGDTANPYGASKAMVERMLTDIQKADPRWSVILLRYFNPIGAHESGLIGEQPNGVPNNLLPYICQVASGRLPQLSVFGGDYPTPDGTGMRDYIHVMDLAEGHIAAMKAKGGVAGVHLFNLGSGRAYSVLEIIRAFEAASGLHIPYRIQPRRAGDLACSYADPSHTKQQTGWETKRGLQQMMEDSWRWVSRNPGRYGD

SEQ ID NO: 7409 - DNA, 912 bp, Neisseria gonorrhoeae
atggttcaaaatgggcatttgtgtaaacggttttcgcaaagtgccgccatggtagcctatcggcggaatatgccgcaaggtcggcaggaaaaaggagaagaaatggacaaaatcagagttgccgccgtgcagatggtgtcgggcgtgtcgccggaaaccaacgtcgccgccatgaaacgcctggtcgcacgggcggcggagcagggtgcggattgggtgctgctgcccgaatattgggtgctgatgggcgcaaacgataccggcaaactcgcacttgccgagcctttgggcggcggacgctttcagacggcattgagcgaaacggcgaaagaatgcggcgtggtgctgttcggcggaaccgtgccgctgcaaagccccgaagcgggcaaggtcatgaatactttattggtgtacgggtgcgacggcgtaaggacggggctgtaccacaaaatgcacctcttcggtttttccggtttgggcgaacgctatgccgaagccgataccatccgcgcagggcgggaagtgccgcacttgtcggcagaaggcatgccggtggcggcaggtatttgttacgatgtccgctttcccgaatttttccgccgccaactgccgtttgacgtattgatgctgccggcggcatttacccatacgacgggcaaggcgcactgggagctgctgctgcgcgcgcgcgccgtcgaaaaccaatgttacgtcgtggcggcggcacagggcggtttgcacgaaaacggacggcgcacgttcggacacagtatgattgtcgatccgtggggcgacgtgttggacgtattacccgaaggcgaaggcatcgttacggcagacatcgatgccaaccgcctgaacagcgtccgcaaccgcctgcccgccttgaaacaccgggttttggatgccgtc

SEQ ID NO: 7410 - protein, 304 aa, Neisseria gonorrhoeae
MVQNGHLCKRFSQSAAMVAYRRNMPQGRQEKGEEMDKIRVAAVQMVSGVSPETNVAAMKRLVARAAEQGADWVLLPEYWVLMGANDTGKLALAEPLGGGRFQTALSETAKECGVVLFGGTVPLQSPEAGKVMNTLLVYGCDGVRTGLYHKMHLFGFSGLGERYAEADTIRAGREVPHLSAEGMPVAAGICYDVRFPEFFRRQLPFDVLMLPAAFTHTTGKAHWELLLRARAVENQCYVVAAAQGGLHENGRRTFGHSMIVDPWGDVLDVLPEGEGIVTADIDANRLNSVRNRLPALKHRVLDAV

SEQ ID NO: 7411 - DNA, 930 bp, Neisseria gonorrhoeae
ttgcggcatattccgccgataggctaccatggcggcactttgcgaaaaccgtttacacaaatgcccattttgaaccatattgccctcatcggtgtagggctgatcggcggttcgttcgttctcgacctcaaaaggcagggactcgtccgcaccgttaccggtatcgacaccgaccgcgacaacctcgaacgtgcattggaacgcggcgtgattgaccgtgcgtccgtcgtcatcgacgcggacagcatcggcggtgcggacttggtactgattgccacgcccgtcgccaccgttcccgccgttttaaccgcgctgcgccccgttttgccggaacacacttggatttccgatgtcggcagcaccaaatcttcggtcatcgaagccttccgccgctgcctgcccggccgcctgcaccgctgcatcgccgcacacccgattgccggttcggacagaaacggtgcgcaagccgcgcagttcgggctgttccgccacagaaaactcatcatcacgccccacggcggcgaagattcagacggcatcgcattggtagaaaacctgtggcgcgcggtcggtgcggacattttcacgatggacgcgcaacaccacgacgcggttttcgccgccgtctcccatatgccccacctgaccgccttcgcctatgtccaccagattctcgaccaccccgacgggcaggaatatctgaaattcgccgccacgggctttcgggacttcacccgcatcgcctccggccatcccgccgtgtgggcggacatctgccttgccaacaaagacagcctgctgcaactggttcaaggcttgggcaaacagttggacgttttggcagacatcctgaccgccgacgaccgcgaagccctgtaccgctattttgaagaagccaaaaccacgcgcgaccgctggctggacggcaac

SEQ ID NO: 7412 - protein, 310 aa, Neisseria gonorrhoeae
LRHIPPIGYHGGTLRKPFTQMPILNHIALIGVGLIGGSFVLDLKRQGLVRTVTGIDTDRDNLERALERGVIDRASVVIDADSIGGADLVLIATPVATVPAVLTALRPVLPEHTWISDVGSTKSSVIEAFRRCLPGRLHRCIAAHPIAGSDRNGAQAAQFGLFRHRKLIITPHGGEDSDGIALVENLWRAVGADIFTMDAQHHDAVFAAVSHMPHLTAFAYVHQILDHPDGQEYLKFAATGFRDFTRIASGHPAVWADICLANKDSLLQLVQGLGKQLDVLADILTADDREALYRYFEEAKTTRDRWLDGN

SEQ ID NO: 7413 - DNA, 96 bp, Neisseria gonorrhoeae
atggcggtttggaagttacctgaaattcaaaaaaaaaacggaaaccggacggattggattcccgcctgcgcgggaatgacggattttaggtttttt

SEQ ID NO: 7414 - protein, 32 aa, Neisseria gonorrhoeae
MAVWKLPEIQKKNGNRTDWIPACAGMTDFRFF

SEQ ID NO: 7415 - DNA, 657 bp, Neisseria gonorrhoeae
acctacgcgggcaatctcgaatcgctgaccgacattgccgataatccccgctacgcttttgagcaagtggatatttgcgaccgcgccgaactcgaccgcgtgttcgcgcaataccggcccgatgccgtgatgcacttggcggcggaaagccacgtcgaccgcgccatcggttcggcaggcgaatttatccgaaccaatatcgtcggcacattcgacctgctggaagctgcgcgcgcctattggcagcaaatgccgtctgaaaaacgcgaagccttccgtttccaccatatttctaccgatgaagtctatggcgatttgcacggcacagacgatttgtttacagaaaccacgccatacgcgccgtccagcccctactccgcctccaaagccgccgccgaccaccttgtccgcgcgtggcagcggacttacaggctgccctccattgtcagcaactgttccaataattacggcccccgacaattccccgaaaaactcattcctttgatgattctgaacgcactttccggcaaaccactgcctgtgtacggcgacggggcgcaaatccgcgactggctgtttgtcgaagaccacgcgcgcgcgctgtatcaggtcgttaccgaaggtgttgtcggcgaaacctacaatatcggcggacac

SEQ ID NO: 7416 - protein, 219 aa, Neisseria gonorrhoeae
TYAGNLESLTDIADNPRYAFEQVDICDRAELDRVFAQYRPDAVMHLAAESHVDRAIGSAGEFIRTNIVGTFDLLEAARAYWQQMPSEKREAFRFHHISTDEVYGDLHGTDDLFTETTPYAPSSPYSASKAAADHLVRAWQRTYRLPSIVSNCSNNYGPRQFPEKLIPLMILNALSGKPLPVYGDGAQIRDWLFVEDHARALYQVVTEGVVGETYNIGGH

SEQ ID NO: 7417 - DNA, 198 bp, Neisseria gonorrhoeae
ttgttaatccgctatatcgtcattcccgcaaaaacaaaaaaaatcaaaaacagaaaactgaaatatcgtcattcccgcgcaggcgggaatctaggtctgtcggtacggaaacttatcgggaaaaacggtttttccaaccctgagactccggattcctgttttcgcgggaatccggtttttttgagtttcagtcatttt

SEQ ID NO: 7418 - protein, 66 aa, Neisseria gonorrhoeae
LLIRYIVIPAKTKKIKNRKLKYRHSRAGGNLGLSVRKLIGKNGFSNPETPDSCFRGNPVFLSFSHF

SEQ ID NO: 7419 - DNA, 1218 bp, Neisseria gonorrhoeae
atggctgtcaacctgaccgaaaaaaccgccgaacaactgcccgacatcgacggcattgccctctacaccgcccaagcaggcgtgaagaagcccgggcataccgacctgacactgattgccgtagccgccggcagcaccgtcggtgcagtcttcacgaccaaccgtttctgtgccgcgcccgtccacatcgccaaatcgcaccttttcgacgaagacggcgtgcgcgccctcgtcatcaacacgggcaacgccaacgcgggtacgggcgcacagggcagaatcgatgctttggcagtgtgtgccgccgccgcccggcaaatcggctgcaaaccgaaccaggtgatgcccttctccaccggcgtgattctcgaaccgctgcccgcagacaaaatcatcgccgccctgcccaaaatgcagcctgccttctggaacgaagcggcacgcgccatcatgaccaccgacaccgttcccaaagccgcctcgcgcgaaggcaaggtcggcgaccaacacaccgtccgcgccacaggcattgccaaaggctcgggcatgattcatcccaatatggcgaccatgctcggtttcatcgccaccgatgccaaagtttcccaacccgtcctccaactgatgacgcaggaaatcgccgacgaaaccttcaacaccatcaccgttgacggcgacaccagcaccaacgacagcttcgtcatcatcgccaccggcaaaaacagccaaagcgaaatcgacaacatcgccgacccgcgttacgcccaactcaaagaattgttgtgcagccttgcgctcgaactcgcccaagccatcgtccgcgacggcgagggcgcgaccaagttcatcaccgtccgcgtcgaaaacgccaaaacctgcgacgaagcccgccaagccgcctacgccgcggcacgttcgccactggtcaaaaccgcctttttcgcctccgaccccaacctcggcaggctgctcgccgccatcggttatgccgacgttgccgacctcgataccgacctcgtggaaatgtatctcgacgatattttggttgccgaacacggcggacgcgccgcaagctacaccgaagcacaagggcaggcggtgatgtcgaaggacgaaatcaccgtccgcatcaagctgcatcgcggacaagccgccgccaccgtctatacctgcgacctgtcgcacggatacgtttccatcaacgccgactaccgttcc

SEQ ID NO: 7420 - protein, 406 aa, Neisseria gonorrhoeae
MAVNLTEKTAEQLPDIDGIALYTAQAGVKKPGHTDLTLIAVAAGSTVGAVFTTNRFCAAPVHIAKSHLFDEDGVRALVINTGNANAGTGAQGRIDALAVCAAAARQIGCKPNQVMPFSTGVILEPLPADKIIAALPKMQPAFWNEAARAIMTTDTVPKAASREGKVGDQHTVRATGIAKGSGMIHPNMATMLGFIATDAKVSQPVLQLMTQEIADETFNTITVDGDTSTNDSFVIIATGKNSQSEIDNIADPRYAQLKELLCSLALELAQAIVRDGEGATKFITVRVENAKTCDEARQAAYAAARSPLVKTAFFASDPNLGRLLAAIGYADVADLDTDLVEMYLDDILVAEHGGRAASYTEAQGQAVMSKDEITVRIKLHRGQAAATVYTCDLSHGYVSINADYRS

SEQ ID NO: 7421 - DNA, 1059 bp, Neisseria gonorrhoeae
gatgccgcgcaagagttcgttcacgctggttttggcgcgggtttgcgcgtccacgcgtttgacgatgacggcacagtaaaggctgtggctgccgtctttggaaggcaggctgccggacacgacgaccgaacctgccggtacgcggccttggtagatttcgcctgtggtacggtcgaagattttggtggattgaccgatgaacacgcccatcgaaatcacgctgccttcttcgacaatcgcgccttcgacgatttcggaacgcgcgccgatgaagcagttgtcttcaatgatggtgggtgcggcctgcaggggttcgagtacgccgccgatgccgacaccgccgctcaagtggacgtttttgccgatttgcgcgcaagagccgacggtcgcccaagtatcgaccatcgcgccttcgtcgacgtatgcgccgatgttgacgtaagacggcatcagcacggcgtttttggcaacaaagctgccgcgtcgggcaaccgcacccggaactgcgcggaagcctgcgtttttgaactcgtcttcagaccagtcggcaaatttggtcggcactttgtcgaagtatttgttcacgccgtcgttgaggacttcgttgtcttggatgcggaaggacagcaacacggcttttttcgcccattcgttgactttccactcgcccacgcccaagcgttcggcgacgcgcagtttgcctgaatcgagttggcggatggtttccaacacggcttctttgacttcgggggcaacggtggtcggagtgatgtccgcgcggttttcaaaggcggtttcgataatgttttgcaaagacataatgtttccttggttcgagatatttcgggacgcttgccggtattgttcagacggcatggcggttggaacaaacgtgctattgtgccatacaaacgcccgcccgtcagccgcgccgcaggcttgccggatgccggcgtttcggaatcgggcgggcggcaggcatatgtctttttccgcgcccgaatcaatacagaaaggcggcggtacttttatgccgcaccgccgcctttcagacggcat

SEQ ID NO: 7422 - protein, 234 aa, Neisseria gonorrhoeae
DAAQEFVHAGFGAGLRVHAFDDDGTVKAVAAVFGRQAAGHDDRTCRYAALVDFACGTVEDFGGLTDEHAHRNHAAFFDNRAFDDFGTRADEAVVFNDGGCGLQGFEYAADADTAAQVDVFADLRARADGRPSIDHRAFVDVCADVDVRRHQHGVFGNKAAASGNRTRNCAEACVFELVFRPVGKFGRHFVEVFVHAVVEDFVVLDAEGQQHGFFRPFVDFPLAHAQAFGDAQFA

SEQ ID NO: 7423 - DNA, 522 bp, Neisseria gonorrhoeae
ttgctttcccaaatttatactctatttgttaaaatcaataataaatacaaggtaatccaaatgaaagaactagataaaatcgatttccgcatcctcaaaattcttcagcaaaatgcccgtatcccgatgacggagcttgccgagaaggtagggttgtccagcacgcccgttacagagagggtatgccgtttggagcgggaacattatatttccggctatcacgtccatctcaatccccatctgttgggcaaaccgccattggtttttgtcgagctgaagctgcaatccaaatcgggcaatattttcgaagatttcaaaaaagaagtgctgaaaattccgcaaattatggagtgccatctggtgtcgggcgaatacgactacctgattaaagtacgtttgcccgatatgtctgcctatcgggatatgctcggcaatatcctattgcaactgcctgccgcttcggagagtaggagttatgttgtgatggaggaagtcaaagaaaatccggttttggatttggat

SEQ ID NO: 7424 - protein, 174 aa, Neisseria gonorrhoeae
LLSQIYTLFVKINNKYKVIQMKELDKIDFRILKILQQNARIPMTELAEKVGLSSTPVTERVCRLEREHYISGYHVHLNPHLLGKPPLVFVELKLQSKSGNIFEDFKKEVLKIPQIMECHLVSGEYDYLIKVRLPDMSAYRDMLGNILLQLPAASESRSYVVMEEVKENPVLDLD

SEQ ID NO: 7425 - DNA, 1038 bp, Neisseria gonorrhoeae
atgcaaaccgcaggcaaaaaaaacatcctcgttaccggcggcgcgggttttatcggctcggcagtcgtccgccatattatccaaaacacccgagattccgtcgtcaacctcgacaagttaacctacgcgggcaatctcgaatcgctgaccgacattgccgataatccccgctacgcttttgagcaagtggatatttgcgaccgcgccgaactcgaccgcgtgttcgcgcaataccggcccgatgccgtgatgcacttggcggcggaaagccacgtcgaccgcgccatcggttcggcaggcgaatttatccgaaccaatatcgtcggcacattcgacctgctggaagctgcgcgcgcctattggcagcaaatgccgtctgaaaaacgcgaagccttccgtttccaccatatttctaccgatgaagtctatggcgatttgcacggcacagacgatttgtttacagaaaccacgccatacgcgccgtccagcccctactccgcctccaaagccgccgccgaccaccttgtccgcgcgtggcagcggacttacaggctgccctccattgtcagcaactgttccaataattacggcccccgacaattccccgaaaaactcattcctttgatgattctgaacgcactttccggcaaaccactgcctgtgtacggcgacggggcgcaaatccgcgactggctgtttgtcgaagaccacgcgcgcgcgctgtatcaggtcgttaccgaaggtgttgtcggcgaaacctacaatatcggcggacacaatgaaaaaaccaatctcgaagtgatcaaaaccatctgcgccctcttggaagaactcgcccccgaaaaaccggccggcgtggcacggtatgaagatttaattactttcgtacaagaccgccccggccatgatgcccgctacgccgtcgatgcggcgaaaatcaggcgggatttgggctggctgcctttggaaacttttgaatccggcctccgcaaaaccgtgcaatggtatttggacaacaaaacccggcggcaaaacgca

SEQ ID NO: 7426 - protein, 346 aa, Neisseria gonorrhoeae
MQTAGKKNILVTGGAGFIGSAVVRHIIQNTRDSVVNLDKLTYAGNLESLTDIADNPRYAFEQVDICDRAELDRVFAQYRPDAVMHLAAESHVDRAIGSAGEFIRTNIVGTFDLLEAARAYWQQMPSEKREAFRFHHISTDEVYGDLHGTDDLFTETTPYAPSSPYSASKAAADHLVRAWQRTYRLPSIVSNCSNNYGPRQFPEKLIPLMILNALSGKPLPVYGDGAQIRDWLFVEDHARALYQVVTEGVVGETYNIGGHNEKTNLEVIKTICALLEELAPEKPAGVARYEDLITFVQDRPGHDARYAVDAAKIRRDLGWLPLETFESGLRKTVQWYLDNKTRRQNA

SEQ ID NO: 7427 - DNA, 1200 bp, Neisseria gonorrhoeae
atgattccgttttgcggcaaatatattaatgataaacaaggaacacacatgaaatttaccaaacatcccgtctgggcaatggcgttccgcccgttttattcactggcggcactgtacggcgcattgtccgtattgctgtggggtttcggctacacgggaacgcacgagctgtccggtttctattggcacgcgcatgagatgatttggggttatgccggtctcgtcgtcatcgccttcctgctgaccgccgtcgccacttggacgggacagccgcccacgaggggcggcgttctggtcggcttgaccgccttttggctggctgcgcggattgccgcctttatcccgggttggggtgcggcggcaagcggcatactcggtacgctgtttttctggtacggcgcggtgtgcatggctttgcccgttatccgttcgcaaaaccggcgcaactatgtcgccgtattcgcaatatttgtgctgggcggtacgcatgcggcgttccacgtccagctgcacaacggcaacctaggcggactcttgagcggattgcagtcgggcctggttatggtgtcgggctttatcggcctgattgggatgaggattatttcgttttttacgtccaaacggttgaacgtgccgcagattcccagtccgaaatgggtggcgcaggcttcgctgtggctacccatgctgaccgccatactgatggcgcacggcgtgatgccttggctgtcggcggctttcgcgtttgcggcgggcgtgatttttaccgtacaggtgtaccgctggtggtataaacccgtattgaaagaaccgatgctgtggattctgtttgccggctatctgtttaccggattggggctgattgcggtcggcgcgtcttatttcaaacctgccttcctcaatctgggcgtacatctgatcggggtcggcggtatcggcgtgctgactttgggcatgatggcgcgtaccgcgctcggtcatacgggcaattcgatttatccgccgcccaaagccgttcccgttgcgttttggctgatgatggcggcaaccgccgtccgtatggttgccgtattttcttccggcactgcctacacgcacagcatccgcacgtcttcggttttgtttgcactcgcgctgctggtgtatgcgtggaaatacattccgtggctgatccgtccgcgttcggacggcaggcccggt

SEQ ID NO: 7428 - protein, 400 aa, Neisseria gonorrhoeae
MIPFCGKYINDKQGTHMKFTKHPVWAMAFRPFYSLAALYGALSVLLWGFGYTGTHELSGFYWHAHEMIWGYAGLVVIAFLLTAVATWTGQPPTRGGVLVGLTAFWLAARIAAFIPGWGAAASGILGTLFFWYGAVCMALPVIRSQNRRNYVAVFAIFVLGGTHAAFHVQLHNGNLGGLLSGLQSGLVMVSGFIGLIGMRIISFFTSKRLNVPQIPSPKWVAQASLWLPMLTAILMAHGVMPWLSAAFAFAAGVIFTVQVYRWWYKPVLKEPMLWILFAGYLFTGLGLIAVGASYFKPAFLNLGVHLIGVGGIGVLTLGMMARTALGHTGNSIYPPPKAVPVAFWLMMAATAVRMVAVFSSGTAYTHSIRTSSVLFALALLVYAWKYIPWLIRPRSDGRPG

SEQ ID NO: 7429 - DNA, 771 bp, Neisseria gonorrhoeae
atgagtgcgaacatccttgccatcgccaatcagaagggcggtgtgggcaaaacgacgacgacggtaaatttggcggcttcgctggcatcgcgcggcaaacgcgtgctggtggtcgatttggatccgcagggcaatgcgacgacgggcagcggcatcgacaaggcgggtttgcagtccggcgtttatcaggtcttattgggcgatgcggacgtgcagtcggcggcggtacgcagcaaagagggcggatacggcgtgttgggtgcgaaccgcgcgcttgccggcgcggaaatcgagctggtgcaggaaatcgcccgggaagtgcgtttgaaaaacgcgctcaaggcagtggcggaagattacgactttatcctgatcgactgtccgccttcgctgacgctgttgacgcttaacggcttggtggcggcgggcggcgtgattgtgccgatgttgtgcgaatattacgcgctggaagggatttccgatttgattgcgaccgtgcgcaaaatccgtcaggcggtcaatcccgatttggacatcacgggcatcgtgcgtacgatgtacgacagccgcagcaggctggttgccgaagtcagcgaacagttgcgcagccatttcggggatttgctttttgaaaccgccatcccgcgcaatatccgccttgcggaagcgccgagccacggtatgccggtgatggcttacgacgcgcaggcaaagggtgccaaggcgtatcttgccttggcggacgaactggcggcgagggtgtcggggaaa

SEQ ID NO: 7430 - protein, 257 aa, Neisseria gonorrhoeae
MSANILAIANQKGGVGKTTTTVNLAASLASRGKRVLVVDLDPQGNATTGSGIDKAGLQSGVYQVLLGDADVQSAAVRSKEGGYGVLGANRALAGAEIELVQEIAREVRLKNALKAVAEDYDFILIDCPPSLTLLTLNGLVAAGGVIVPMLCEYYALEGISDLIATVRKIRQAVNPDLDITGIVRTMYDSRSRLVAEVSEQLRSHFGDLLFETAIPRNIRLAEAPSHGMPVMAYDAQAKGAKAYLALADELAARVSGK

SEQ ID NO: 7431 - DNA, 621 bp, Neisseria gonorrhoeae
atggaacgtaaagaacgcctgcgtgcaggcattgccgcgatggggccggatatttcggaaacggcgcaggacaggcttttggcctatgtggatttgttgaaaaagtggaacaaaacctacaatctgaccgccctgcgcgacgaggaaaaaatgattgtccatcatcttttggacagcctgacgctgctgccctatatcgaaggcgcacagacgatgctggatgtcggttcgggcggcggccagcccggcattccggcggcggtgtgccgtccggatgtgcagataaccttgttggatgcgaatacgaagaaaacggcttttttgcggcaggcggctatcgagttggggttggacaatgtgcgcgtggtgtcggggcgcgtggaggcggtttcggacgtgcgtgccgacgtggttaccagccgtgcgtttgcggaactggcggattttgtgtcgtggacggcgcacctgttgaaagacggcggctactgggcggcgatgaagggcgtatatccgcagggggaaatcggccgcctgccgcaggatgtgtgcgtcgaaaaagtccaaaggctcgacgtgccgggcttggatgcggaacgccatatcgtcatcctgagcaagcgt

SEQ ID NO: 7432 - protein, 207 aa, Neisseria gonorrhoeae
MERKERLRAGIAAMGPDISETAQDRLLAYVDLLKKWNKTYNLTALRDEEKMIVHHLLDSLTLLPYIEGAQTMLDVGSGGGQPGIPAAVCRPDVQITLLDANTKKTAFLRQAAIELGLDNVRVVSGRVEAVSDVRADVVTSRAFAELADFVSWTAHLLKDGGYWAAMKGVYPQGEIGRLPQDVCVEKVQRLDVPGLDAERHIVILSKR

SEQ ID NO: 7433 - DNA, 804 bp, Neisseria gonorrhoeae
atgccgtctgaagcgcgctcaacgcttgctcaggatgacgatatggcgttccgcatccaagcccggcacgtcgagcctttggactttttcgacgcacacatcctgcggcaggcggccgatttccccctgcggatatacgcccttcatcgccgcccagtagccgccgtctttcaacaggtgcgccgtccacgacacaaaatccgccagttccgcaaacgcacggctggtaaccacgtcggcacgcacgtccgaaaccgcctccacgcgccccgacaccacgcgcacattgtccaaccccaactcgatagccgcctgccgcaaaaaagccgttttcttcgtattcgcatccaacaaggttatctgcacatccggacggcacaccgccgccggaatgccgggctggccgccgcccgaaccgacatccagcatcgtctgtgcgccttcgatatagggcagcagcgtcaggctgtccaaaagatgatggacaatcattttttcctcgtcgcgcagggcggtcagattgtaggttttgttccactttttcaacaaatccacataggccaaaagcctgtcctgcgccgtttccgaaatatccggccccatcgcggcaatgcctgcacgcaggcgttctttacgttccatatctgcttcctgtccatattcaggcgtaatgttagcggaaaaacatgccgtctgaaaccgcgtatcgggtttcagacggcatttccgttccgtcctattttttcctgtggaacaccacaggctgcaccggcgcgcgcgtcaggcgtttcggcagcgtcagca

SEQ ID NO: 7434 - protein, 268 aa, Neisseria gonorrhoeae
MPSEARSTLAQDDDMAFRIQARHVEPLDFFDAHILRQAADFPLRIYALHRRPVAAVFQQVRRPRHKIRQFRKRTAGNHVGTHVRNRLHAPRHHAHIVQPQLDSRLPQKSRFLRIRIQQGYLHIRTAHRRRNAGLAAARTDIQHRLCAFDIGQQRQAVQKMMDNHFFLVAQGGQIVGFVPLFQQIHIGQKPVLRRFRNIRPHRGNACTQAFFTFHICFLSIFRRNVSGKTCRLKPRIGFQTAFPFRPIFSCGTPQAAPARASGVSAASA

SEQ ID NO: 7435 - DNA, 1008 bp, Neisseria gonorrhoeae
atggtatttggacaacaaaacccggcggcaaaacgcataaaacggcaactgccgttcggaacgcttaggtacgggcaaatagttttcagacagcatcccgacgcaatgccgtctgaaaacccatcgcaaaggaagaaagaaaagatgaaaggcatcatactggcaggcggcagcggtacgcgcctatatccgattacgcgcggcgtatccaaacaactgctgcccgtgtacgacaaaccgatgatttattaccccttgtcggttttgatgctggcgggaatccgcgatattttggtaattaccgcacccgaagacaacgctgccttccaacggctactcggcgacggctccgacttcggcatccgcctgcaatatgccgttcaacccagccccgacggcttggcgcaggcatttatcatcggcgaagaatttatcggcaacggcaatgtctgcctgattttgggcgacaatattttctacggtcaatcatttacgcaaacattgaaacaggccgccgccaagacccacggcgcaaccgtattcggttatcgggttaaagaccccgagcgtttcggcgtggttgaatttgacgaaaacttcaacgccttatccatcgaagagaaaccgcaacagcccaaatccgattgggcggtaaccggcttgtacttccacgacaaccgcgccgtcgagttcgccaaacagctcaaaccgtccgcacgcggcgaattggaaatttccgacctcaaccggatgtatctggaagacggctcgctgtccgttcaaatattgggacgcggtttcgcgtggttggacaccggcacgcaagaaagcctgcacgaggcggcttccttcgtccaaaccgtgcaaaatatccaaaacctgcacatcgcctgcctcgaagaaatcgcctggcgtaacggctggctgacgaaaaaagatgtggaaacacgggcaaagcctttggaaaaaaccgcctacgggcaatacctgctgcgcctgatcggcaaa

SEQ ID NO: 7436 - protein, 336 aa, Neisseria gonorrhoeae
MVFGQQNPAAKRIKRQLPFGTLRYGQIVFRQHPDAMPSENPSQRKKEKMKGIILAGGSGTRLYPITRGVSKQLLPVYDKPMIYYPLSVLMLAGIRDILVITAPEDNAAFQRLLGDGSDFGIRLQYAVQPSPDGLAQAFIIGEEFIGNGNVCLILGDNIFYGQSFTQTLKQAAAKTHGATVFGYRVKDPERFGVVEFDENFNALSIEEKPQQPKSDWAVTGLYFHDNRAVEFAKQLKPSARGELEISDLNRMYLEDGSLSVQILGRGFAWLDTGTQESLHEAASFVQTVQNIQNLHIACLEEIAWRNGWLTKKDVETRAKPLEKTAYGQYLLRLIGK

SEQ ID NO: 7437 - DNA, 255 bp, Neisseria gonorrhoeae
atgccgtctgaaaccgcgtatcgggtttcagacggcatttccgttccgtcctattttttcctgtggaacaccacaggctgcaccggcgcgcgcgtcaggcgtttcggcagcgtcagcatagacaccagccacacggcaaacgcatattccgacaccgcctccccgctcagcccgcccaaggcggcactgcccaacaacagcttgaaaatccaagccaccgccgcgcaagccgccacgcccgacagaaacagcgcg

SEQ ID NO: 7438 - protein, 85 aa, Neisseria gonorrhoeae
MPSETAYRVSDGISVPSYFFLWNTTGCTGARVRRFGSVSIDTSHTANAYSDTASPLSPPKAALPNNSLKIQATAAQAATPDRNSA

SEQ ID NO: 7439 - DNA, 366 bp, Neisseria gonorrhoeae
atgaaaccgttgaaacgacattccgcccttgtcgggctttcgcgcgaacaccaccactcgctttccctgtgcgtgcgtatgttgcggacgcccggggcagaccatcgtgccgaactcgagctgcattttgccgaactggaaacccattttcgcgaagaagaagccaagtttgccccaatttggcagaatgtcgcgcctgagttgaaaacccgttttgaaggcgatcacgccaaactgcggcagatgatggcaagccccgaatgcggtaacgcggcgtggaataccgcttttgccacaaccctgcgcgaccacgcgcgctttgaagaacgcgagctgtttcccgccgtcgaaccgtttttgccggca

SEQ ID NO: 7440 - protein, 122 aa, Neisseria gonorrhoeae
MKPLKRHSALVGLSREHHHSLSLCVRMLRTPGADHRAELELHFAELETHFREEEAKFAPIWQNVAPELKTRFEGDHAKLRQMMASPECGNAAWNTAFATTLRDHARFEERELFPAVEPFLPA

SEQ ID NO: 7441 - DNA, 573 bp, Neisseria gonorrhoeae
atgatatatataaacggttgtttgtgcaacttttcgggcgggcggcaaggcggtgcgcggtataatgcggcctgcttcggaagaggggggacggcgatgtttgtgaacgagaaatatccttatgcgaccctgtttgcggggctggtgtttttgacgctgccgtttgcgttggcggtgcatgatgcctttgcatgtgcgttcggacgggcggggctgctggtgtcggtgtcggacggcggattcggccggcgtggcggttgggacggcactgtttggtttgtgttcggtgtgtttgcgtttttgaatgtggttgtgtcggcgggcctgacgaaactggcgtacaaaaagatgatgcggcggcattcgcgttacgcgctgtttctgtcgggcgtggcggcttgcgcggcggtggcttggattttcaagctgttgttgggcagtgccgccttgggcgggctgagcggggaggcggtgtcggaatatgcgtttgccgtgtggctggtgtctatgctgacgctgccgaaacgcctgacgcgcgcgccggtgcagcctgtggtgttccacaggaaaaaa

SEQ ID NO: 7442 - protein, 191 aa, Neisseria gonorrhoeae
MIYINGCLCNFSGGRQGGARYNAACFGRGGTAMFVNEKYPYATLFAGLVFLTLPFALAVHDAFACAFGRAGLLVSVSDGGFGRRGGWDGTVWFVFGVFAFLNVVVSAGLTKLAYKKMMRRHSRYALFLSGVAACAAVAWIFKLLLGSAALGGLSGEAVSEYAFAVWLVSMLTLPKRLTRAPVQPVVFHRKK

SEQ ID NO: 7443 - DNA, 555 bp, Neisseria gonorrhoeae
atggacatcatcgacaccgccctccccgacgtaaaacttttaaaaccgcaagtcttcacagacgggcgcggtttttttatggaaacattccgcgacggatggttcaaagaaaatattgccgatcgaactttcgtgcaggaaaaccactccaactccagcaagggcgtattgcgcggcctgcactaccaaaccgaaaacacccaaggcaaactcgtacgcatagttgtcggcgaagtgttcgacgtggccgtcgatatgcgcgaaggttcgccgactttcggcaaatgggcgggcgcaaccttgtcggcgcaaaaccgataccagctttggatacccgaaggcttcgcacacggtttttgcgttttgggcgacgcggcggaagtcgtgtacaaatgcacggactattacaaccctgaaaccgaacaggttttaatatggaacgacccggcaatcggcataggctggccgcttcaaaccgcgccgctactttcgcccaaagaccttgccggcaaaacgtgggcacaagccgaaaagctccgccttacgctttcccga

SEQ ID NO: 7444 - protein, 185 aa, Neisseria gonorrhoeae
MDIIDTALPDVKLLKPQVFTDGRGFFMETFRDGWFKENIADRTFVQENHSNSSKGVLRGLHYQTENTQGKLVRIVVGEVFDVAVDMREGSPTFGKWAGATLSAQNRYQLWIPEGFAHGFCVLGDAAEVVYKCTDYYNPETEQVLIWNDPAIGIGWPLQTAPLLSPKDLAGKTWAQAEKLRLTLSR

SEQ ID NO: 7445 - DNA, 441 bp, Neisseria gonorrhoeae
atgtatctgacccaacataccgactacgggctgcgcgtcctcatctacaccgccgtcaacgacgacgcgctggtcaatatcgccaccatcgcctcgacctacggcatttccaaaagccatttgatgaaagtggttaccgcgctggtcaaaggcgggttcttgcacagcgtacgcgggaaaggcggcgggctgaggctggccgcgccgcccgaacgcatcaatatcggcgcggtcgtccgccacctcgaaccgatgcagctggtcgagtgtatgggcccgaacaacgaatgcctgattacgccgtcctgccggctgacgggcatactcggcggtgcaatgaagtcgtttttcacgtatctggacggtttcacgctgcaagacctgctcaacaagccgacctacgacctgctttatgaatcgaaaatcccgattgcggtgcga

SEQ ID NO: 7446 - protein, 147 aa, Neisseria gonorrhoeae
MYLTQHTDYGLRVLIYTAVNDDALVNIATIASTYGISKSHLMKVVTALVKGGFLHSVRGKGGGLRLAAPPERINIGAVVRHLEPMQLVECMGPNNECLITPSCRLTGILGGAMKSFFTYLDGFTLQDLLNKPTYDLLYESKIPIAVR

SEQ ID NO: 7447 - DNA, 1290 bp, Neisseria gonorrhoeae; identical to SEQ ID NO: 5699

SEQ ID NO: 7448 - protein, 430 aa, Neisseria gonorrhoeae; identical to SEQ ID NO: 5700

SEQ ID NO: 7449 - DNA, 1227 bp, Neisseria gonorrhoeae; identical to SEQ ID NO: 5731

SEQ ID NO: 7450 - protein, 409 aa, Neisseria gonorrhoeae; identical to SEQ ID NO: 5732

SEQ ID NO: 7451 - DNA, 123 bp, Neisseria gonorrhoeae
atgccggcgcgtatcgcgcccggtcggaatatccgtttgaaacggcaaacaaaatgccgtccgaacgcgggtttgggcggcattttgatgcgttatcgcaccgcaatcgggattttcgattca

SEQ ID NO: 7452 - protein, 41 aa, Neisseria gonorrhoeae
MPARIAPGRNIRLKRQTKCRPNAGLGGILMRYRTAIGIFDS

SEQ ID NO: 7453 - DNA, 1959 bp, Neisseria gonorrhoeae
cctacccgccttcagtacgcgctgtgcaaagaaaaacatcccggtaacgaagaacgccaagcccaaccaagaagcggcggcatcccagttttgcagattcaacgcgagcggcgcatccgagccgccgttggtcacagagaaggcaataataaacgccataattacaccaatcaggctttcaccgacaatcaggcctgccgcgaaaagcgtaccgatacggtcggcgtttttcagacggccttcgcggttttccgccttcttgccaatgatgtgtttcaacaccgccgccaacaccgcgcctgccacgatgggcatattgacggacggcggcagataaatgcccataccgaccgcaaggacgggcagggcaagtttaccgcctgatgattttttcaacaccaaatcgacgacgattaataccgctccaatcgcgataccggtaaagatgtacgcccattcgaggttgtgggcgaaaatgcccgacgcaatggtcgtcatcaaagtcgcttgaagggctgccaaagcctgcgccgcatccatgccttcgcgcggcattgcgccggtaaagccgtaggcttcgtaaagcagttccaacacgggcgaaataaccagcgcaccaacgatacagccgataatcagggcgacttgctgccgccaaggcgtagctttgagcaggtagccggttttcaagtcttgcaggttgtcgttggaaatcgaagccacgcagattactgccgatccgcaaaaaagcgtcaacgccagtaagaatttgcggttggcctcatccgccaacaaacctccggattcgcctaccagcagcaaaaccagtgaaataacgacgatggacacgatgcccacgccggaaatcgggctggaagacgagccgaccaaacctgccatataaccgcaggcggcggcgaccaaaaagccgatgacggaagccaaaagcgtgcaaaccgccaccaaaagccacgccatgccgcccgtaatgtgcgaatcgccgataaagtggtaaaacgacacgcctagaataaacatcatagacaacacccagaaaatcatggctttaggcgacaaatcctgttcggcgcgttctgtagcgggcgcaccgccgccaaaactcttgaacgacatcttcatgccttccaccattggcttgagcagcatcaaaagcgtccaaaccgccgcgatacctatggttcccgcaccgataaaacgcactttttccttccacagcttcatcgcaaacgccgccatttccatatcggaaggttgcggaatgtgtgaggagaaatacggcacggcaataccccaagcaatcgaaatgcccagcaggatggcgatgccgcccgtcagtccgaccaaataacccgcgcccaacaaggccagtgaaaagcctatcggcagttggaaaattgccgtaccgcttttaaaccaataactcgcgctatcggcaatcacacgcagacctccggagcaaaagctcatcaatcccgccaacgcgccgccggccgccagctctttgataccgctgccgccctgacggtcatccccttcttcatgaccgcccactttcaaaatttcagcagccgccacaccttccggataaggcaaatcgcttttcaccaccatcgcgtaacgcagcggaatggtgaaaatcacccccaaaatcccgccggcaatacataaaagcgtcgtctgccaaaacgggaaaccgctccagtagcccgccatcagcaaaccgggcaggacgaagatgatggttgaaagcgtacccgcagccgaggcttgggtctgcaccatgttgttttccaaaatattgctgcctttgaaaaattttaaaaccgccatcgaaatcaccgccgccggaatcgacgaggcaaaggtcagcccgactttcaaaccgaggtaaacgttagacgcagtaaaaattacagtgatcaatgcgccgagtatcat

SEQ ID NO: 7454 - protein, 127 aa, Neisseria gonorrhoeae
PTRLQYALCKEKHPGNEERQAQPRSGGIPVLQIQRERRIRAAVGHREGNNKRHNYTNQAFTDNQACREKRTDTVGVFQTAFAVFRLLANDVFQHRRQHRACHDGHIDGRRQINAHTDRKDGQGKFTA

SEQ ID NO: 7455 - DNA, 771 bp, Neisseria gonorrhoeae
atgccgtctgaagcatcagccgttcagacggcatcgcgcgccttgccggcggcagcccgaaatgccggcgcgtatcgcgcccggtcggaatatccgtttgaaacggcaaacaaaatgccgtccgaacgcgggtttgggcggcattttgatgcgttatcgcaccgcaatcgggattttcgattcataaagcaggtcgtaggtcggcttgttgagcaggtcttgcagcgtgaaaccgtccagatacgtgaaaaacgacttcattgcaccgccgagtatgcccgtcagccggcaggacggcgtaatcaggcattcgttgttcgggcccatacactcgaccagctgcatcggttcgaggtggcggacgaccgcgccgatattgatgcgttcgggcggcgcggccagcctcagcccgccgcctttcccgcgtacgctgtgcaagaacccgcctttgaccagcgcggtaaccactttcatcaaatggcttttggaaatgccgtaggtcgaggcgatggtggcgatattgaccagcgcgtcgtcgttgacggcggtgtagatgaggacgcgcagcccgtagtcggtatgttgggtcagatacatgattttctcggtatggatcgttattcttatcggtacggtttaagtttcacggaaaataccttaatggttgaaaccctgtccgtcggggcggtagaatgtagcctgtctgcggcggtatgccgtctgaaacatccgcgctaccgtttgataatttgttattgtaacctaaattta

SEQ ID NO: 7456 - protein, 257 aa, Neisseria gonorrhoeae
MPSEASAVQTASRALPAAARNAGAYRARSEYPFETANKMPSERGFGRHFDALSHRNRDFRFIKQVVGRLVEQVLQRETVQIREKRLHCTAEYARQPAGRRNQAFVVRAHTLDQLHRFEVADDRADIDAFGRRGQPQPAAFPAYAVQEPAFDQRGNHFHQMAFGNAVGRGDGGDIDQRVVVDGGVDEDAQPVVGMLGQIHDFLGMDRYSYRYGLSFTENTLMVETLSVGAVECSLSAAVCRLKHPRYRLIICYCNLNL

SEQ ID NO: 7457 - DNA, 120 bp, Neisseria gonorrhoeae
atgcctcggagcgtcagttcgcggtatttttctaccgaaccggataaagatttattcattattcttcctttgacaacagacgttcacatattgttggcatcacgccatgatgtcaagttt

SEQ ID NO: 7458 - protein, 40 aa, Neisseria gonorrhoeae
MPRSVSSRYFSTEPDKDLFIILPLTTDVHILLASRHDVKF

SEQ ID NO: 7459 - DNA, 90 bp, Neisseria gonorrhoeae
ttgggaaagcaattatatcaggaaaagcaaaccgccttcctacctgaaaactgctgctctggcttgaagacacaaggttctttaatattt

SEQ ID NO: 7460 - protein, 30 aa, Neisseria gonorrhoeae
LGKQLYQEKQTAFLPENCCSGLKTQGSLIF

SEQ ID NO: 7461 - DNA, 819 bp, Neisseria gonorrhoeae
ttgttcggcggttttttcggtcaggttgacagccataacggttctccttgcgagtgtgtcggcgttcagacggcatgggttgaaatgccgtctgaaacgggttcagaaccccaaaacggggataagcagcggcgcaatcagcgcggtcagcacgccgttgaacgtcagccccatccccgcgtatgccgccatgcggcggctgcgttcgagcgaggcggcaatgcccatcgcgtgcgaagccgtgccgagcgacatacccacggacgagggcatgacgaccgtgttcttcaacattttgtaaccggcaatctgtccgaccagaccggcaatgatgacggtggcggcggtaatggcgggaatgccgccgatggagcgggtgatttcgatggcgatggggttggtaacagatttggacgcgagcgggaggacgacttcgcgttccgcgcccagccacttggcaaaatacatccccgtaacaatgcccgtaacgctgcccgcaagctgcgaaacgatgacgggcagccactggttgaagattttacggcggttttggtagagcggcacggcaagcacgacgacggcgggtttcagccgaaaatcaatgaattgcgcggcgttgtggtacaccgcataatcgataccgaggattttcaggtaggcaatcagcacgatagtgctgacgagtacggggttgcagaagatattgcccgtgcgcgtgcgcacgataatcgcaagcgcgtacacggcaagcgtgaggaaaagcagaacgctgggctgcctgaggatttcgctcatcagataatgctccgtatccagcgg

SEQ ID NO: 7462 - protein, 273 aa, Neisseria gonorrhoeae
LFGGFFGQVDSHNGSPCECVGVQTAWVEMPSETGSEPQNGDKQRRNQRGQHAVERQPHPRVCRHAAAAFERGGNAHRVRSRAERHTHGRGHDDRVLQHFVTGNLSDQTGNDDGGGGNGGNAADGAGDFDGDGVGNRFGREREDDFAFRAQPLGKIHPRNNARNAARKLRNDDGQPLVEDFTAVLVERHGKHDDGGFQPKINELRGVVVHRIIDTEDFQVGNQHDSADEYGVAEDIARARAHDNRKRVHGKREEKQNAGLPEDFAHQIMLRIQR

SEQ ID NO: 7463 - DNA, 402 bp, Neisseria gonorrhoeae; identical to SEQ ID NO: 149

SEQ ID NO: 7464 - protein, 134 aa, Neisseria gonorrhoeae; identical to SEQ ID NO: 150

SEQ ID NO: 7465 - DNA, 1143 bp, Neisseria gonorrhoeae
atcaaacaaatcgcgcagcttgtctaaaaacgatttcttgcgcggcgtttggttttccaagcccgtagaaatccgctcaaattcttccaaaagctctttttgacggtcggtcaaattgacaggcgtttcgacaacaatatggcagtacaaatcgccggtcgcgctgctgcgtaaagatttgacacccttacctttcacgcgcatcctcctgccggtttgggtttctttggggacggtgagcttgactttgccgtccaaggtcggcacttctaactccccgcccaaagcagccatggcaaaactaatcggcagttcgcaatgcaaatccaaaccatcgcgttggaaaatcttatgcgcccgaatgcggacggttacatacaggtcgccggcaggcgcgccgtgcatacccggcccgccttcaccgctcaaacggatacgctgcccgtcatcgataccggcgggaatattgacttccaccgtcttgaccgccttattccgccccacgccacggcatttgacgcaaggttctttaatatgtttgcccgcaccgcggcaggtcggacaagtctgctgcatacggaaaatcgcctgctggatgtgcaccgtacccgaacctttgcaagtcgggcaggtttccggggatgcccccggtttcgcgccgctgccgttgcagacatcacacgcttcataagtcggaatattgatgcgtttcttcacaccttttgcggcttcttcaagcgtgatttcgataccgacctgcacgtcctcaccctgataatcaggctgggcgcgccccgaaccacctccaaacatttggctgaaaatatccccaaagtcaaaaccctgcgcaccgccaaatccgccaaaccctccgaagcccccctgtccgccgccttcaaacgccgcatgaccatactggtcgtacatggcacgcttttccttgtcggacaaagtttcatacgccttttgtacttctttaaacttctcttccgcctctttattgtcaggattgcggtcgggatggtatttcatcgccaatttacggtaggcttttttaatctcatcatcggtagctgctcttgccacacccagcgtcgcataaaaatcttgattactcattttttcatctaaaaataaaatcac

SEQ ID NO: 7466 - protein, 8 aa, Neisseria gonorrhoeae
IKQIAQLV

SEQ ID NO: 7467 - DNA, 639 bp, Neisseria gonorrhoeae
atgacgataaggaaacaaactatggcacaatttttcgccgttcatcccgacaatccccaagaacgcctcatcaagcaggcagtcgaaatcatcaatcaaggcggcgtggtggtttatccgaccgattcctgttacgccttgggttgcaaactcggcgataaggcggcgatggaacgcatactctccatccgaaaaatcgatttgaaacaccacctgaccctgatgtgcgccgatttgagcgagttgggcacatacgccaaaatcgacaacgtacagtttcgtcagcttaaagccgccacgcccgggccttatacctttatcttgcaggcgacgaaggatgcgccggcgcgcgccctgcacccgaaacgcaaaaccatcgggctgcgtattcccgataatgccgttgcacaagccctgctggaggagttgggcgggccgcttttaagctgcaccctgatgctgcccgaagacggcgaaccattgaccgacccttatgaaatccgcgagcgtttggaacacgccgtcgatttggtgattgacggcggctggtgcggaaccgatccgactaccgtcatcgacatgaccgacggcacggaactggtgcgccggggtttcggcgatacggcggtgttcggtttg

SEQ ID NO: 7468 - protein, 213 aa, Neisseria gonorrhoeae
MTIRKQTMAQFFAVHPDNPQERLIKQAVEIINQGGVVVYPTDSCYALGCKLGDKAAMERILSIRKIDLKHHLTLMCADLSELGTYAKIDNVQFRQLKAATPGPYTFILQATKDAPARALHPKRKTIGLRIPDNAVAQALLEELGGPLLSCTLMLPEDGEPLTDPYEIRERLEHAVDLVIDGGWCGTDPTTVIDMTDGTELVRRGFGDTAVFGL

SEQ ID NO: 7469 - DNA, 447 bp, Neisseria gonorrhoeae
atgagcaccttcttccggcaaaccgcccaagccatgactgccaaacacatcggccgcttcccgctattggagttggaccaggtgattgattggcagccgatcgaacaatacctgaaccgtcaaaaaacccgttacctcagagaccgccgcggccgccccgcctatcccctgtcgtccatgttcaaagccgtcctgcccggacaatggcacagcctctccgatcccgaactcgaacacagcctcatcacccgcatcggtttcaacctgttttgccgttttgacggaccgggcatccccggttgcagcaccttatgccgctaccgtaaattccgctatgcgcgggcagcctatttcgggctgctcaaagtgggtgcgcaaagccacctgaaggcgatgtgtttgaacctgttgaaagccgccaacaggctaagtgcgcccgctgccgcc

SEQ ID NO: 7470 - protein, 149 aa, Neisseria gonorrhoeae
MSTFFRQTAQAMTAKHIGRFPLLELDQVIDWQPIEQYLNRQKTRYLRDRRGRPAYPLSSMFKAVLPGQWHSLSDPELEHSLITRIGFNLFCRFDGPGIPGCSTLCRYRKFRYARAAYFGLLKVGAQSHLKAMCLNLLKAANRLSAPAAA

SEQ ID NO: 7471 - DNA, 408 bp, Neisseria gonorrhoeae; identical to SEQ ID NO: 151

SEQ ID NO: 7472 - protein, 136 aa, Neisseria gonorrhoeae; identical to SEQ ID NO: 152

SEQ ID NO: 7473 - DNA, 162 bp, Neisseria gonorrhoeae
ttggggcgaaaacagctgaaaacctgtgtttgggtttcggctgtcgaaggaagggcttttttgcaaaggtctcagaatgccacagcttacaaactgaaacggaatacacttttcagatatgcacgacacaaaaacttagataggtataaaaccaaccgccat

SEQ ID NO: 7474 - protein, 54 aa, Neisseria gonorrhoeae
LGRKQLKTCVWVSAVEGRAFLQRSQNATAYKLKRNTLFRYARHKNLDRYKTNRH

SEQ ID NO: 7475 - DNA, 1023 bp, Neisseria gonorrhoeae; identical to SEQ ID NO: 153

SEQ ID NO: 7476 - protein, 341 aa, Neisseria gonorrhoeae; identical to SEQ ID NO: 154

SEQ ID NO: 7477 - DNA, 1197 bp, Neisseria gonorrhoeae
atgtccgaccaactcattcttgtcctgaactgcgtcagttcatcgctcaaaggcgccgttatcgaccgcaaaagcggcagcgtcgtcctaagctgcctcggggaacgcctgactacgcccgaagccgtcattaccttcaacaaagacggcaacaaacgccaagttcccctgagcggccgcaactgccacgccggcgcggtgggtatgctgttgaacgaactggaaaaacacggactgcacgaccgcatcaaagccatcggccgccgcatcgcccacggcggcgaaaaatatcacgagtccgtcctcatcgaccaagacgtccttgacgaactgaaagcctgcatcccgttcgccccgctgcacaaccccgccaacatcagcggcatcctcgccgcgcaggaacactttcccggcctgcccaacgtcggcgtgatggacacctcgttccaccaaaccatgccggagcgggcctacacttatgccgtgccgcgcgaattgcgcaaaaaatacgccttccgccgctacggtttccacggtaccggtatgcgttacgtcgcccctgaagccgcacgcatcttgggcaaacctctggaagacatccgcatgattattgcccacttaggcaacggcgcatctattaccgccgtcaaaaacggcaaatccgtcgataccggtatgggtttcacgccgatcgaaggtttggtaatgggtacacgttgcggcgacaccgatccgggcgtatacagctatccgactttccacgcagggatggatgttgcccaagttgatgaaatgctgaacgaaaaatcaggtttccccggtatttccgaacttcccaacgactgccgcaccctcgaaatcgccgccgacgaaggccgcgaaggcgcgcgcctcgccctcgaagtcatgacctgccgcctcgccaaatacatcgcttcgatggctgtggcctgcggcagtgttgacgcactcgtgttcaccggcggtatcggcgaaaactcgcgtaatatccgtgccaaaaccgtttcctatcttgatttcttgggtctgcacatcgacaccaaagccaatatggaaaaacgctacggcaattcgggcattatcagcccgaccgattcttctccggctgttttggtcgtcccgaccaatgaagaactgatgattgcctgcgacactgccgaacttgccggcatcttg

SEQ ID NO: 7478 - protein, 399 aa, Neisseria gonorrhoeae
MSDQLILVLNCVSSSLKGAVIDRKSGSVVLSCLGERLTTPEAVITFNKDGNKRQVPLSGRNCHAGAVGMLLNELEKHGLHDRIKAIGRRIAHGGEKYHESVLIDQDVLDELKACIPFAPLHNPANISGILAAQEHFPGLPNVGVMDTSFHQTMPERAYTYAVPRELRKKYAFRRYGFHGTGMRYVAPEAARILGKPLEDIRMIIAHLGNGASITAVKNGKSVDTGMGFTPIEGLVMGTRCGDTDPGVYSYPTFHAGMDVAQVDEMLNEKSGFPGISELPNDCRTLEIAADEGREGARLALEVMTCRLAKYIASMAVACGSVDALVFTGGIGENSRNIRAKTVSYLDFLGLHIDTKANMEKRYGNSGIISPTDSSPAVLVVPTNEELMIACDTAELAGIL

SEQ ID NO: 7479 - DNA, 522 bp, Neisseria gonorrhoeae
ttgcatcgattcattccccgatatagcgcaggtctttctccagccatttcccttccaaacaaagaacaaaaaagcgccggcggcagccgatgccccttcctttacaggttcccctattttttaaccgcaggcagcaccggtttggcggggccttttggtgcgggcgcgccgacggaagcctggtctttcagcttcgccagcaccgccggaccgatgcccttcaccttgatcaaatcgtccacagacttgaacgcgccgttttgcgcgcggtattccgcaatggccttcgccgggcctatgcccggcagcgcctccagctcctgctgcgaagccgcattgatgtttaccgccgcaagggagaaggcgcaggagaacagcatacagaacaatacaaacatttttttcatggtttttcctttaagggttgcaaacaacaaaccgcatcttgcgacgatatggcggattaacaaaaaccggtacggcgttgccccgccccggctcaaagggaacgattccctaagg

SEQ ID NO: 7480 - protein, 174 aa, Neisseria gonorrhoeae
LHRFIPRYSAGLSPAISLPNKEQKSAGGSRCPFLYRFPYFLTAGSTGLAGPFGAGAPTEAWSFSFASTAGPMPFTLIKSSTDLNAPFCARYSAMAFAGPMPGSASSSCCEAALMFTAAREKAQENSIQNNTNIFFMVFPLRVANNKPHLATIWRINKNRYGVAPPRLKGNDSLR

SEQ ID NO: 7481 - DNA, 624 bp, Neisseria gonorrhoeae; identical to SEQ ID NO: 5841

SEQ ID NO: 7482 - protein, 208 aa, Neisseria gonorrhoeae; identical to SEQ ID NO: 5842

SEQ ID NO: 7483 - DNA, 213 bp, Neisseria gonorrhoeae
ttgggcaaagcgtatgccgtatttcctagcgtcattcccacgcaggcgggaatccatatttgctcacacgcaggctctgataaaaatcaggaaacagaatatcggctgcggattcccgcctgcgtgggaatgacggcggtgaggttattcggctttatggtaatccttaatcaaatgccgtctgaaacagcggacagcaatgtgcgtcctaca

SEQ ID NO: 7484 - protein, 71 aa, Neisseria gonorrhoeae
LGKAYAVFPSVIPTQAGIHICSHAGSDKNQETEYRLRIPACVGMTAVRLFGFMVILNQMPSETADSNVRPT

SEQ ID NO: 7485 - DNA, 417 bp, Neisseria gonorrhoeae
ttttttaaccgcaggcagcaccggtttggcggggccttttggtgcgggcgcgccgacggaagcctggtctttcagcttcgccagcaccgccggaccgatgcccttcaccttgatcaaatcgtccacagacttgaacgcgccgttttgcgcgcggtattccgcaatggccttcgccgggcctatgcccggcagcgcctccagctcctgctgcgaagccgcattgatgtttaccgccgcaagggagaaggcgcaggagaacagcatacagaacaatacaaacatttttttcatggtttttcctttaagggttgcaaacaacaaaccgcatcttgcgacgatatggcggattaacaaaaaccggtacggcgttgccccgccccggctcaaagggaacgattccctaaggtgatgaagcac

SEQ ID NO: 7486 - protein, 116 aa, Neisseria gonorrhoeae
FFNRRQHRFGGAFWCGRADGSLVFQLRQHRRTDALHLDQIVHRLERAVLRAVFRNGLRRAYARQRLQLLLRSRIDVYRRKGEGAGEQHTEQYKHFFHGFSFKGCKQQTASCDDMAD

SEQ ID NO: 7487 - DNA, 771 bp, Neisseria gonorrhoeae; identical to SEQ ID NO: 5875

SEQ ID NO: 7488 - protein, 257 aa, Neisseria gonorrhoeae; identical to SEQ ID NO: 5876

SEQ ID NO: 7489 - DNA, 180 bp, Neisseria gonorrhoeae; identical to SEQ ID NO: 1263

SEQ ID NO: 7490 - protein, 58 aa, Neisseria gonorrhoeae; identical to SEQ ID NO: 1264

SEQ ID NO: 7491 - DNA, 648 bp, Neisseria gonorrhoeae; identical to SEQ ID NO: 1283

SEQ ID NO: 7492 - protein, 216 aa, Neisseria gonorrhoeae; identical to SEQ ID NO: 1284

SEQ ID NO: 7493 - DNA, 795 bp, Neisseria gonorrhoeae; identical to SEQ ID NO: 5893

SEQ ID NO: 7494 - protein, 265 aa, Neisseria gonorrhoeae; identical to SEQ ID NO: 5894

SEQ ID NO: 7495 - DNA, 609 bp, Neisseria gonorrhoeae
atgttcccaaccggcaatttggtcgacgaaattgatgtgccgaatataggtcgtctgaaagccacgctcatcaacgcgggcattccgaccgttttcctgaacgccgccgacttgggctacacgggcaaagagttgcaggacgacatcaacaacgatgccgccgcgctggaaaaatttgaaaccatccgcgcatatggcgcgctgaaaatgggtttgatcagcgacgtatccgaagccgccgcccgcgcgcgcacgccgaaacccgccttcgtcgcgcccgccgccgattacaccgcctccagcggcaaaaccgtaaacgccgccgacatcgatttgccggtacgcgccctgagcatgggcaaactgcaccacgctatgatgggcatcgcctcggtcgccatcgccgccgccgtgctcggtacgctggtcaaccttgccgcaggcggcggaacgcgtaaagaagtgcgcttcgggcatccgtcaggtacgctgcgtgtcggtgctgccgccgaatgtcaggacggacaatggacggccgccaaagcggtcatgagccgcagcgcacgcgtgattatggaaggttgggtgcgcgttcccgatgattgtttt

SEQ ID NO: 7496 - protein, 203 aa, Neisseria gonorrhoeae
MFPTGNLVDEIDVPNIGRLKATLINAGIPTVFLNAADLGYTGKELQDDINNDAAALEKFETIRAYGALKMGLISDVSEAAARARTPKPAFVAPAADYTASSGKTVNAADIDLPVRALSMGKLHHAMMGIASVAIAAAVLGTLVNLAAGGGTRKEVRFGHPSGTLRVGAAAECQDGQWTAAKAVMSRSARVIMEGWVRVPDDCF

SEQ ID NO: 7497 - DNA, 111 bp, Neisseria gonorrhoeae; identical to SEQ ID NO: 1301

SEQ ID NO: 7498 - protein, 37 aa, Neisseria gonorrhoeae; identical to SEQ ID NO: 1302

SEQ ID NO: 7499 - DNA, 381 bp, Neisseria gonorrhoeae; identical to SEQ ID NO: 1319

SEQ ID NO: 7500 - protein, 127 aa, Neisseria gonorrhoeae; identical to SEQ ID NO: 1320

SEQ ID NO: 7501 - DNA, 1233 bp, Neisseria gonorrhoeae; identical to SEQ ID NO: 5927

SEQ ID NO: 7502 - protein, 411 aa, Neisseria gonorrhoeae; identical to SEQ ID NO: 5928

SEQ ID NO: 7503 - DNA, 525 bp, Neisseria gonorrhoeae
atgccgcaaatcaaaatccccgccgtttactaccgcggcggtacatctaaaggcattttcttcaaacgcaccgatctgccggcagctgcgcaggaagcaggcggggcgcgcgacaaaatcctcttgcgcgtactcggcagccccgacccttacggcaaacagattgacggtttgggcaacgccagttcgtccaccagcaaagctgtgatttcggacaaatccgaacgcgccgatcacgatgtcgattacttgttcggacaagtttccatcgacaaaccatttgtcgattggagcggcaactgcggcaaccttaccgccgccgtgggcacattcgccatcgaacagggcttggtcgataaatccaaaatcccttcagacggcatctgcacggtcaaaatctggcagaaaaacatcggcaaaaccattattgcccatgtgccgatgcaaaacggagcagtgttggaaacaggcgatttcgagcttgacggcgtaattttccggcagccgaagtacaaatcgaatttt

SEQ ID NO: 7504 - protein, 175 aa, Neisseria gonorrhoeae
MPQIKIPAVYYRGGTSKGIFFKRTDLPAAAQEAGGARDKILLRVLGSPDPYGKQIDGLGNASSSTSKAVISDKSERADHDVDYLFGQVSIDKPFVDWSGNCGNLTAAVGTFAIEQGLVDKSKIPSDGICTVKIWQKNIGKTIIAHVPMQNGAVLETGDFELDGVIFRQPKYKSNF

SEQ ID NO: 7505 - DNA, 408 bp, Neisseria gonorrhoeae; identical to SEQ ID NO: 1333

SEQ ID NO: 7506 - protein, 136 aa, Neisseria gonorrhoeae; identical to SEQ ID NO: 1334

SEQ ID NO: 7507 - DNA, 1131 bp, Neisseria gonorrhoeae
ttgccgttggattataattccccaattgatttcttaattttgctaataaacacttgtttggtaaggaatgaatttatgcggcctttgaacgtgcagatcaggttgggcaaccttaggcacaattatcggattttgaaggaaatgcacggaggcaagctgttggcggtagtgaaggccgacgcatacggacacggtgcggtcagatgtgctttcgcgctggcagacttggcagacggctttgccgtggcgacaatcgacgagggaatcaggctgcgggagagcggcattacccatccgattgtccttttagaaggcgtatttgaagcatcagagtacgaagcggtcgaacaatactcgctttggccggcagtcggaaaccaatggcagcttgaggctttgctttcccgccattggaaaaaacctgtcaaggtctggttgaaaatggattcgggaatgcaccgtaccggatttttccctcatgattacacttcggcatatgcggcattgaaacagtcggaatatgtggacagtattgtcaagttctcgcatttctcctgtgcggacgaacctgaaagcggtatgacggaaatacagatggaagcattcgatttgggtacgaaagggctggaaggcgaagaaagccttgccaattcggcagctattttgaatatccccgaagcacgcagggattgggggcgcgcgggcttggcgttatacggcatttccccgttcggaggcagcgatgacaggctgaaacccgtgatgaggctttcaacccgtattttcggcgaacgcgttttacagccgcactcccctatcggttatggcgcaacattttataccagtaaatctacgcgcgtcggtctgattgcctgcggttatgcggacggttatccgcgccgcgctccaagcaattcccccgtcgccgtcgacggtaaattgacccgggtcatcggcaggatctctatggatatgatgactatcgagctggacgcttcgcaagaaggtttgggacacgaggtcgaactgtggggcgatacggtcaatatcaataccgttgccgaagcggccggaaccatcccttacgaattgatgtgcaatatcaaacgtgcaaaattcacttatatcgag

SEQ ID NO: 7508 - protein, 377 aa, Neisseria gonorrhoeae
LPLDYNSPIDFLILLINTCLVRNEFMRPLNVQIRLGNLRHNYRILKEMHGGKLLAVVKADAYGHGAVRCAFALADLADGFAVATIDEGIRLRESGITHPIVLLEGVFEASEYEAVEQYSLWPAVGNQWQLEALLSRHWKKPVKVWLKMDSGMHRTGFFPHDYTSAYAALKQSEYVDSIVKFSHFSCADEPESGMTEIQMEAFDLGTKGLEGEESLANSAAILNIPEARRDWGRAGLALYGISPFGGSDDRLKPVMRLSTRIFGERVLQPHSPIGYGATFYTSKSTRVGLIACGYADGYPRRAPSNSPVAVDGKLTRVIGRISMDMMTIELDASQEGLGHEVELWGDTVNINTVAEAAGTIPYELMCNIKRAKFTYIE

SEQ ID NO: 7509 - DNA, 1698 bp, Neisseria gonorrhoeae
tgccgcaccgccgcctttcagacggcattcgcggtaaaacgccatcagcccttcggtcgaggcatcgtgtacggacgtgccgccttccagttcgccgatgatggtttttgccaactgtttgccgtactcaaccccccactgatcgaaggggttgacgttccatatcgcgccttggacgaaggttttgtgttcgtaagccgccatcagcatacccagattgcagggcgtgaggcggtcgagcaggatgctgttgctggggcggttgccggggaactctttgtgcggcgcgaggcgttcgcgttccgcttcgggcaaatctgccagttcggcgcgtgcttcgtctaaggttttacccttcatcagggcttccgcttgggcaaaggcgttggcaacggtaaaacggctgcgtccgtcctccgcgccctgcgccgtcatcgggacgataaagtcgcagggaatcaggcgcgtgccttggtggagcagttggaaataggcgtgctggcagttgaccccttcaccgccgaacacgatgccgcccgttttgcacgcggcgggactgccgtctgaagcgcggcttttgcccaaactctccatatcgagctggttcagccacgccggcagcaggcgcaggttgtggctgtacggaacggcggtctgcccgtccgcgtgctggaaattgttataccacacggcaatcagtgccatcagaacgggaatgttgcgacgcgggggcgtgtggaaaaaatggctgtccatcgcgtgcgcccccgctagcagttcgcggaaacgcgccccgccaaccgcaaccatcacgggcaaaccgacgggcgaccagacggaatagcgtccgcccacccagtcgtacatcgcaaacacgcgttccgccgcaatgccgaaactttgcgccgcttccgtatcggcagacaccgcgcaaaaatggtgcgccgtttcggattccgagaaccccgcaccgcgataccacgccttgaccgcctctgcattgagcagggtttccggtgttttaaaggacttgctggcaacgcaaaacattgttgtttcggggttcagacggcataagacctcatccaggcaggcagggtcggcattagaaacaaaatggacggaaatctgccgtctgaacggctcgagcgcctgcacgcacattgccggcccgaggtcggatccgcctatgccgatgtggacaaaatccgcaatccgttttccggttatcccctgatataaaccgtcgtccaaactgtgtgcaaacttcaacgcacgatttaactcgcggcggatttcgggcaacacgtccctgccgtccgcataaacggcatccgcaccgtcgggcaggcgcaaagccgtatgcagcgcggcacgcccctcgctgccgttgactttcgcacccgtccgcaaagcacgcattttcccttccaaatccgccgtctccgcaagacggcagagcagttgcagcgtatcttcgccaaaacggtttttgctgtaatcgaacaacatcccgtccaaacgctcatgcatacgctcaaaacggtcgggttcggcagcaaagcggtcgcgcaaaaggatgtggcacgtatcctgataatggcgttcgagcgcataccatgcacgggtaaaagcatccatctgttttccttgatttttcagaaccggattaaaatatagcagaatgtagtctaacaa

SEQ ID NO: 7510 - protein, 114 aa, Neisseria gonorrhoeae
CRTAAFQTAFAVKRHQPFGRGIVYGRAAFQFADDGFCQLFAVLNPPLIEGVDVPYRALDEGFVFVSRHQHTQIAGREAVEQDAVAGAVAGELFVRREAFAFRFGQICQFGACFV

SEQ ID NO: 7511 - DNA, 93 bp, Neisseria gonorrhoeae; identical to SEQ ID NO: 1355

SEQ ID NO: 7512 - protein, 4 aa, Neisseria gonorrhoeae
SKQT

SEQ ID NO: 7513 - DNA, 1944 bp, Neisseria gonorrhoeae
gtgggcggtttggaagcggaaaccgtgatgctgggacgcgcgtccatgatgcgcctgcccgatattgtcggcgtggagctgacgggcaaacggcaggcgggcattactgccacagacatcgtgttggcactgaccgaattcttgcgtaaagagcgcgtggtcggggcgtttgtcgaatttttcggcgagggcgcgagaagcctgtctatcggcgaccgcgcgaccatttccaacatgacgccggagttcggcgcgactgccgccatgttcgccatcgacgcgcaaactattgattatttgaaactgaccggacgtgacgacgcgcaggtgaaattggtggaaacctacgccaaaaccgcaggcttatgggcaggtggcttgaaaaccgccgtttatccgcgcgttttgaaatttgatttgagcagcgtaacgcgcaatatggcaggcccgagcaacccgcacgcgcgttttgccaccgccgatttggcggcgaaagggctggcgaagccttacgaagagccttcagacggccaaatgcctgacggtgcagtgattattgccgcgattacttcgtgtaccaatacttccaacccgcgcaacgttgtcgccgccgcactgttggcacgcaatgccaaccgcctcggcttgaaacgcaaaccttgggtgaaatcttcgtttgccccgggttcaaaagtagccggaatctatttgaaagaagcaggcttgttgcccgaaatggaaaaactcggcttcggtatcgtcgccttcgcatgtaccacctgtaacggcatgagcggcgcgctcgacccgaaaatccaacaagaaatcatcgaccgcgatttgtacgccaccgccgtattgtcaggcaaccgcaacttcgacggccgtatccatccgtatgcgaaacaggctttcctcgcttcgcctcctttggtcgttgcctacgcattggcaggtagcatccgtttcgatattgaaaacgacgtactcggcgttgcagacggccgcgaaatccgcctgaaagatatctggccgacagacgaagaaatcgatgccatcgttgccgaatatgtgaaaccgcaacaattccgcgacatttatatcccgatgtccgacaccggcacagcgcaaaaagcaccaagcccgctgtacgactggcgaccgatgtccacctacatccgccgtccgccctattgggaaggcgcactggcaggggaacgtacattaagaggtatgcgtccgccggcgattttgcccgacaacatcaccaccgaccacatctcgccatccaatgcgattttggccggcagtgccgcaggtgaatatttggcgaaaatgggtttgcctgaagaagacttcaactcttacgcaacccaccgcggcgaccacttgaccgcccaacgcgcaaccttcgccaatccgaaactgtttaacgaaatggtgagaaacgaagacggcagcgtacgccaaggttcgttggcacgcgttgaaccagaaggccaaaccatgcgcatgtgggaagccatcgaaacctatatgaaccgcaaacagccgcttatcatcattgccggtgcggactatggtcaaggctcaagccgcgactgggcggcgaagggcgtgcggctggcgggtgtggaagccatcgccgccgaaggtttcgagcgcatccaccgcaccaacctcatcggcatgggcgtcttgccgctgcaattcaaacccggcaccaaccgccataccctgcaactggacggtacggaaacctacgacgttgtcggcgaacgcacaccgcgctgcggcctgaccctcgtgattcaccgtaaaaacggagaaaccgtcgaagttccggttacctgccgccccgataccgcagaagaagcattggtatatgaagccggcggcgtattgcaacggtttgcacaggactttttggaagggaacgcggct

SEQ ID NO: 7514 - protein, 648 aa, Neisseria gonorrhoeae
VGGLEAETVMLGRASMMRLPDIVGVELTGKRQAGITATDIVLALTEFLRKERVVGAFVEFFGEGARSLSIGDRATISNMTPEFGATAAMFAIDAQTIDYLKLTGRDDAQVKLVETYAKTAGLWAGGLKTAVYPRVLKFDLSSVTRNMAGPSNPHARFATADLAAKGLAKPYEEPSDGQMPDGAVIIAAITSCTNTSNPRNVVAAALLARNANRLGLKRKPWVKSSFAPGSKVAGIYLKEAGLLPEMEKLGFGIVAFACTTCNGMSGALDPKIQQEIIDRDLYATAVLSGNRNFDGRIHPYAKQAFLASPPLVVAYALAGSIRFDIENDVLGVADGREIRLKDIWPTDEEIDAIVAEYVKPQQFRDIYIPMSDTGTAQKAPSPLYDWRPMSTYIRRPPYWEGALAGERTLRGMRPPAILPDNITTDHISPSNAILAGSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIAAEGFERIHRTNLIGMGVLPLQFKPGTNRHTLQLDGTETYDVVGERTPRCGLTLVIHRKNGETVEVPVTCRPDTAEEALVYEAGGVLQRFAQDFLEGNAA

SEQ ID NO: 7515 - DNA, 147 bp, Neisseria gonorrhoeae
ttgtgtcttaatcctgccttttgtgtttcaggattaagtcgatacaatcatcacccaaatactatgtttgttttcttttctcttgcgaaaggtttttatcctttgcaaagaataaaaaatcaaaacaaactcattgtctttgtttgt

SEQ ID NO: 7516 - protein, 49 aa, Neisseria gonorrhoeae
LCLNPAFCVSGLSRYNHHPNTMFVFFSLAKGFYPLQRIKNQNKLIVFVC

SEQ ID NO: 7517 - DNA, 1422 bp, Neisseria gonorrhoeae; identical to SEQ ID NO: 5977

SEQ ID NO: 7518 - protein, 474 aa, Neisseria gonorrhoeae; identical to SEQ ID NO: 5978

SEQ ID NO: 7519 - DNA, 189 bp, Neisseria gonorrhoeae
ttgtgtttcaggattaagtcgatacaatcatcacccaaatactatgtttgttttcttttctcttgcgaaaggtttttatcctttgcaaagaataaaaaatcaaaacaaactcattgtctttgtttgttgatttcggctttccaatttgttaaagatcgatgcgtcgttattctacttcgcaaatcaaaa

SEQ ID NO: 7520 - protein, 63 aa, Neisseria gonorrhoeae
LCFRIKSIQSSPKYYVCFLFSCERFLSFAKNKKSKQTHCLCLLISAFQFVKDRCVVILLRKSK

SEQ ID NO: 7521 - DNA, 684 bp, Neisseria gonorrhoeae
atgactgccaaccaaagttaccgcaaaccgctgcccggtacggatttggaatactacgacgcgcgtgcggcgtgtgaggacatcaaacccggctcttacgacaagctgccgtacacgagccgcattttgtctgagaacttggtcaaccgcgcggacaaagtcgatttgccgatgctgcaaagctggctgggccagttgatagaagggaagcaggaaatcgattttccgtggtatcccgcgcgggtggtgtgccacgatattctggggcagaccgcgctggtggatttggcaggcttgcgcgatgcgattgccgaaaaaggcggcgatcctgccaaagtgaatccggtggtgcagacgcagcttatcgtcgaccactctttggcggtggagtgcggcggttacgatcctgatgccttccgcaaaaaccgcgaaatcgaagacagacgtaacgaagaccgtttccacttcatcaactggacaaaaaccgcatttgaaaatgtggacgtgattccggcgggcaacggcatcatgcaccaaatcaatctggaaaaaatgtcgcccgtcgtccaagtcaaaaacggcgtggctttccccgatacctgcgtcggcacggactcgcatacgccgcacgttgatgcgctgggcgtgatttccgtggcgtgggcggtttggaagcggaaaccg

SEQ ID NO: 7522 - protein, 228 aa, Neisseria gonorrhoeae
MTANQSYRKPLPGTDLEYYDARAACEDIKPGSYDKLPYTSRILSENLVNRADKVDLPMLQSWLGQLIEGKQEIDFPWYPARVVCHDILGQTALVDLAGLRDAIAEKGGDPAKVNPVVQTQLIVDHSLAVECGGYDPDAFRKNREIEDRRNEDRFHFINWTKTAFENVDVIPAGNGIMHQINLEKMSPVVQVKNGVAFPDTCVGTDSHTPHVDALGVISVAWAVWKRKP

SEQ ID NO: 7523 - DNA, 684 bp, Neisseria gonorrhoeae
gtgcggcgtatgcgagtccgtgccgacgcaggtatcggggaaagccacgccgtttttgacttggacgacgggcgacattttttccagattgatttggtgcatgatgccgttgcccgccggaatcacgtccacattttcaaatgcggtttttgtccagttgatgaagtggaaacggtcttcgttacgtctgtcttcgatttcgcggtttttgcggaaggcatcaggatcgtaaccgccgcactccaccgccaaagagtggtcgacgataagctgcgtctgcaccaccggattcactttggcaggatcgccgcctttttcggcaatcgcatcgcgcaagcctgccaaatccaccagcgcggtctgccccagaatatcgtggcacaccacccgcgcgggataccacggaaaatcgatttcctgcttcccttctatcaactggcccagccagctttgcagcatcggcaaatcgactttgtccgcgcggttgaccaagttctcagacaaaatgcggctcgtgtacggcagcttgtcgtaagagccgggtttgatgtcctcacacgccgcacgcgcgtcgtagtattccaaatccgtaccgggcagcggtttgcggtaactttggttggcagtcatgtcggttctcctgtggatctatttttcttgtggtttgggtttcagccgatgttt

SEQ ID NO: 7524 - protein, 228 aa, Neisseria gonorrhoeae
VRRMRVRADAGIGESHAVFDLDDGRHFFQIDLVHDAVARRNHVHIFKCGFCPVDEVETVFVTSVFDFAVFAEGIRIVTAALHRQRVVDDKLRLHHRIHFGRIAAFFGNRIAQACQIHQRGLPQNIVAHHPRGIPRKIDFLLPFYQLAQPALQHRQIDFVRAVDQVLRQNAARVRQLVVRAGFDVLTRRTRVVVFQIRTGQRFAVTLVGSHVGSPVDLFFLWFGFQPMF

SEQ ID NO: 7525 - DNA, 180 bp, Neisseria gonorrhoeae; identical to SEQ ID NO: 1385

SEQ ID NO: 7526 - protein, 12 aa, Neisseria gonorrhoeae
LSLFVDFGFPIC

SEQ ID NO: 7527 - DNA, 2376 bp, Neisseria gonorrhoeae; identical to SEQ ID NO: 6025

SEQ ID NO: 7528 - protein, 792 aa, Neisseria gonorrhoeae; identical to SEQ ID NO: 6026

SEQ ID NO: 7529 - DNA, 132 bp, Neisseria gonorrhoeae; identical to SEQ ID NO: 1409

SEQ ID NO: 7530 - protein, 44 aa, Neisseria gonorrhoeae; identical to SEQ ID NO: 1410

SEQ ID NO: 7531 - DNA, 786 bp, Neisseria gonorrhoeae
atggaagatttatacataatactcgctttgggtttggttgcgatgatcgccggatttatcgatgcgattgcgggcgggggtggtttgattacgctgcctgcactcttgttggcaggtattcctcccgtgtcggcaattgccaccaacaagctgcaagcagccgctgctacgttttcggctacggtttcttttgcacgcaaaggtttgattgattggaagaaaggtctcccgattgccgcagcatcgtttgcaggcggcgtggtcggtgcattatcggtcagcttggtttccaaagatattttgctggcggtcgtgccggttttgttgatatttgtcgcgctgtattttgtgttttcgcccaagctcgacggcagtaaggaaggcaaagccagaatgtctttttttctattcgggctgacggttgcaccgcttttgggtttttacgacggtgtgttcggaccgggtgtcggctcgttttttctgattgcctttattgttttgctcggctgcaagctgttgaacgcgatgtcttacaccaaattggcgaacgttgcttgcaatcttggttcgctatcggtattcctgctgcacggttcgattattttcccgattgtggcaacgatggcggtcggtgcgtttgtcggtgcgaatttaggtgcgagatttgccgtccgcttcggttcgaagctgattaagccgctgctgattgtcatcagcatttcgatggctgtgaaattgttgatagacgagagaaatccgctgtatcagatgattgtttcgatgttt

SEQ ID NO: 7532 - protein, 262 aa, Neisseria gonorrhoeae
MEDLYIILALGLVAMIAGFIDAIAGGGGLITLPALLLAGIPPVSAIATNKLQAAAATFSATVSFARKGLIDWKKGLPIAAASFAGGVVGALSVSLVSKDILLAVVPVLLIFVALYFVFSPKLDGSKEGKARMSFFLFGLTVAPLLGFYDGVFGPGVGSFFLIAFIVLLGCKLLNAMSYTKLANVACNLGSLSVFLLHGSIIFPIVATMAVGAFVGANLGARFAVRFGSKLIKPLLIVISISMAVKLLIDERNPLYQMIVSMF

SEQ ID NO: 7533 - DNA, 204 bp, Neisseria gonorrhoeae; identical to SEQ ID NO: 1435

SEQ ID NO: 7534 - protein, 68 aa, Neisseria gonorrhoeae; identical to SEQ ID NO: 1436

SEQ ID NO: 7535 - DNA, 555 bp, Neisseria gonorrhoeae; identical to SEQ ID NO: 6055

SEQ ID NO: 7536 - protein, 185 aa, Neisseria gonorrhoeae; identical to SEQ ID NO: 6056

SEQ ID NO: 7537 - DNA, 198 bp, Neisseria gonorrhoeae
agatatctctcgatatttccgacattccgtgctatacttttcagttcgtccgccgcttcggcagcggcgaagaaccgaactatacgcccgcaggggaaaacagtcaatactttcagcgggatttttttggggaaattcgtcatgtcgctgtcggataaggttttttatctccgccaaacgctgcgccgcctccaacaa

SEQ ID NO: 7538 - protein, 66 aa, Neisseria gonorrhoeae
RYLSIFPTFRAILFSSSAASAAAKNRTIRPQGKTVNTFSGIFLGKFVMSLSDKVFYLRQTLRRLQQ

SEQ ID NO: 7539 - DNA, 1146 bp, Neisseria gonorrhoeae
atgactgaaactactcaaaccccgaccttcaaacctaaaaaatccgttgcgctttcaggtgttgcggccggtaataccgctttgtgtaccgttggccgtaccggtaacgatttgagccatcgcggttacgacattctaaatttggcacaaaaatgcgagtttgaagaagtcgcacacttgctgattcacggccatctgcccaacaaattcgagctggccgcttataaaaccaagctcaaatccatgcgcggcctgcctatccgtgtgattaaagttttggaaagcctgcctgcacatacccatccgatggacgtgatgcgtaccggcgtgtccatgctcggctgcgttcatcccgaacgcgaaagccatcccgacagcgaagcgcgcgacatcgccgacaaactgatcgccagcctgggcagcatcctgctgtactggtatcaatattcgcacaacggcaaacgtattgaagttgaaagcgacgaagagaccgtcggcggtcatttcctgcacctgttgcacggcaaacgcccaagcgaatcacacatcaaagccatgcatgtttcactgattctgtatgccgaacacgagttcaacgcctccacctttactgcccgcgtgattgccggtacgggttcggatatgtattcctgcatcaccggcgccatcggcgcgcttaaaggtccgaaacacggcggtgcgaacgaagtcgcctacgacatccaaaaacgctaccgcaacgccgacgaagccgacatccgcgaacgcatcggccgcaaagaaatcgtgatcggtttcggccatccggtttacaccatttccgacccgcgcaacgtcgtgattaaagaagtggcgcgcggtttgagccgggaagcgggcgacatgcgcctcttcgacatcgccgaacgcttggagagcgtgatgtgggaagagaaaaaaatgttcccgaatctggactggttctctgccgtttcctaccaaaaattgggcgtaccgaccgctatgttcacaccgctgttcgtgatttcgcgatccaccggctgggcggcacacgtcctcgaacagcgcaaagacggcaaaatcatccgtccgagcgcaaactacgccggccctgaagatttggcgtttgtggagattgaagaacga

SEQ ID NO: 7540 - protein, 382 aa, Neisseria gonorrhoeae
MTETTQTPTFKPKKSVALSGVAAGNTALCTVGRTGNDLSHRGYDILNLAQKCEFEEVAHLLIHGHLPNKFELAAYKTKLKSMRGLPIRVIKVLESLPAHTHPMDVMRTGVSMLGCVHPERESHPDSEARDIADKLIASLGSILLYWYQYSHNGKRIEVESDEETVGGHFLHLLHGKRPSESHIKAMHVSLILYAEHEFNASTFTARVIAGTGSDMYSCITGAIGALKGPKHGGANEVAYDIQKRYRNADEADIRERIGRKEIVIGFGHPVYTISDPRNVVIKEVARGLSREAGDMRLFDIAERLESVMWEEKKMFPNLDWFSAVSYQKLGVPTAMFTPLFVISRSTGWAAHVLEQRKDGKIIRPSANYAGPEDLAFVEIEER

SEQ ID NO: 7541 - DNA, 414 bp, Neisseria gonorrhoeae
gtcggcaaactgtttcttcatcctctctcggcgttcttgggcctcaacggataaagtggctgtcgggcgtgccagcagccgcttcaggccgataggttctcccgtatcggcacagaatccatagtccccttcatcaatattgcggatggtcgcctgtattttactgagaagttttcgttcccgatcccgggtacggagttccaatgcgtactcttcttcctgtgtggcacggtcggcaggatcgggggctgattcgtgttcttggagatgccctgttgtaacggaggcgttttcgatgagttcgtcttgcatttttaccagcaattcgcggaaaaaagccaaatggtcgtcattcatataatcgtcttccggcccaatccaattcaaaatatcttgttctgtcagctttaccat

SEQ ID NO: 7542 - protein, 17 aa, Neisseria gonorrhoeae
VGKLFLHPLSAFLGLNG

SEQ ID NO: 7543 - DNA, 93 bp, Neisseria gonorrhoeae
atgatttaccgctttcagacggcctttcaacaaatccgcatcgaccgtctgaaaaataaaacccataaaaatacaaaggagaaataccatgac

SEQ ID NO: 7544 - protein, 31 aa, Neisseria gonorrhoeae
MIYRFQTAFQQIRIDRLKNKTHKNTKEKYHD

SEQ ID NO: 7545 - DNA, 108 bp, Neisseria gonorrhoeae
ttgttctgtcagctttaccataatgtatgccctctcggttcaccgcaaaaaaaaaacaaagcactacaaagtggctttattcctttgatttttataaggcttattgcc

SEQ ID NO: 7546 - protein, 36 aa, Neisseria gonorrhoeae
LFCQLYHNVCPLGSPQKKNKALQSGFIPLIFIRLIA

SEQ ID NO: 7547 - DNA, 1041 bp, Neisseria gonorrhoeae; identical to SEQ ID NO: 6091

SEQ ID NO: 7548 - protein, 347 aa, Neisseria gonorrhoeae; identical to SEQ ID NO: 6092

SEQ ID NO: 7549 - DNA, 447 bp, Neisseria gonorrhoeae; identical to SEQ ID NO: 6109

SEQ ID NO: 7550 - protein, 149 aa, Neisseria gonorrhoeae; identical to SEQ ID NO: 6110

SEQ ID NO: 7551 - DNA, 876 bp, Neisseria gonorrhoeae
atgatgagtcaacactctgccggagcacgtttccgccaagctgtgaaagaatcgaatccgcttgccgtcgccggttgcgtcaatgcttattttgcacgattggccacccaaagcggtttcaaagccatctatctgtccggcggcggcgtggcagcctgttcttgcggtatccctgatttgggcattaccacaatggaagatgtgctgatcgacgcacgacgcattacggacaacgtggatacgcctctgctggtggacatcgatgtgggttggggcggtgcattcaatattgcccgtaccattcgcaactttgaacgcgccggtgttgcagcggttcacatcgaagatcaggtagcgcaaaaacgctgcggccaccgtcggaacaaagccatcgtttccaaagatgaaatggtcgaccgcatcaaagctgccgtagatgcgcgcgttgatgagaacttcgtgattatggcgcgtaccgatgcgctggcggtagaaggtttggatgccgctatcgaacgcgctcaggcttgtgtcgaagccggtgcggacatgattttccctgaagccatgaccgatttgaaaatgtaccgtcaatttgcagatgcagtgaaagtaccagtattggccaacattaccgagtttggtgctacaccgctttatacgcaaagcgagttggctgaaaacggcgtgtcactggtgctgtatccgttgtcatcattccgcgcagcaagcaaagccgctttgaatgtttacgaagcgattatgcgcgatggcactcaggcggcggtggtggacagtatgcaaacccgtgccgagctgtacgagcatctgaactatcatgccttcgatcaaaaactggataaattgtttcaaaaa

SEQ ID NO: 7552 - protein, 292 aa, Neisseria gonorrhoeae
MMSQHSAGARFRQAVKESNPLAVAGCVNAYFARLATQSGFKAIYLSGGGVAACSCGIPDLGITTMEDVLIDARRITDNVDTPLLVDIDVGWGGAFNIARTIRNFERAGVAAVHIEDQVAQKRCGHRRNKAIVSKDEMVDRIKAAVDARVDENFVIMARTDALAVEGLDAAIERAQACVEAGADMIFPEAMTDLKMYRQFADAVKVPVLANITEFGATPLYTQSELAENGVSLVLYPLSSFRAASKAALNVYEAIMRDGTQAAVVDSMQTRAELYEHLNYHAFDQKLDKLFQK

SEQ ID NO: 7553 - DNA, 102 bp, Neisseria gonorrhoeae
gggaatcgttctctttgagccggggcggggcaacgccgtaccggtttttgttaattcactataccctccggccggcatttgacccgcaacaatatcctgcaa

SEQ ID NO: 7554 - protein, 5 aa, Neisseria gonorrhoeae
GNRSL

SEQ ID NO: 7555 - DNA, 114 bp, Neisseria gonorrhoeae
ttggcggattttgcgggcgaggcggcgggggaatgtggaggtcatggtatgttgtccgacggttcagacggcattttatgtatgccgtctgaagccgtgtcgggtcaggaacgg

SEQ ID NO: 7556 - protein, 38 aa, Neisseria gonorrhoeae
LADFAGEAAGECGGHGMLSDGSDGILCMPSEAVSGQER

SEQ ID NO: 7557 - DNA, 807 bp, Neisseria gonorrhoeae
ttgatattgccgttccatttcctgcgaacggcacacacaggcacaaacgccctcacttatggcttcggcgacacgatgccgtctgaaggcttccacggcttcgtgggttgtcccgccttttgacgttacatttttttgaagcttctcgaaatcttcacccgtctgctcggcaagggcaaccgctcctttaaacgttgccagactgagcgcgcgtgcttctgccatatcaaacccttgtcggatggcggcattttgcaatgcgtccagcagataaaacacataagccggcccgctgccgctgatgccggtaatgctgtgcatttgcgcttcatcttccaaccaaacggtcaaaccgactgatttcatgattcgatcggcaatcctgcggtctgtttccgatacttccgcttcggcatacataccggatacgcccagcccgatttttccgggtgtattcggcataacccggacaatgcggcggcttcccccgaggtaacggctgagcgtaccgaccgacaatccggctgcgacagaaagcaccaatgcgccgttggtgcggatatttttgcacgcggcttccatatcctgcggtttgacggcaaggattaaaacatcgtcggaatgaagctccggcagggttgccgaagtttcgacccccaactcttttcccaaacgttcgcgcttttccgcaccacggttggctatatggatgcggtatcccccttgtttgaccaatccgcccgcaacggcagccgccatatttccgccgccgagaaaataaacattcattatttctaccctattcaa

SEQ ID NO: 7558 - protein, 40 aa, Neisseria gonorrhoeae
LILPFHFLRTAHTGTNALTYGFGDTMPSEGFHGFVGCPAF

SEQ ID NO: 7559 - DNA, 552 bp, Neisseria gonorrhoeae
gtgtccctgggtttgaataaacctaaaccggtgggttttctttttattaggtcgtctgaaactttcagacgacctttttccgaacgctcaaaccacgcgtttggcgcacataatcacggcttcgacggcgacttgtccgtccactttggcaacggcgttgaatttgccgatgccgcgccggctggtcaggagttcgacttcaaagacgagttggtcgccggggatgacttggcgtttgaaacgggcttcgtctatgccggcgaagaagaaaaattcgttttccttgcgcccgccttcgctcaaaatcgccaacgtgccgcacgcctgcgccatcgcttcgatgatgagtacgccgggcataacgggcaggtcggggaaatggccttggaattggggttcgtttatggttacgtttttgatggcggtcagggttttcatcggctcgaaggcggtaatgcggtcgagctggagaaacgggtagcggtgggggatgagtttttggatgtctttggcttcgatggggagttgtacgtccatgtctgtcgtattcct

SEQ ID NO: 7560 - protein, 184 aa, Neisseria gonorrhoeae
VSLGLNKPKPVGFLFIRSSETFRRPFSERSNHAFGAHNHGFDGDLSVHFGNGVEFADAAPAGQEFDFKDELVAGDDLAFETGFVYAGEEEKFVFLAPAFAQNRQRAARLRHRFDDEYAGHNGQVGEMALELGFVYGYVFDGGQGFHRLEGGNAVELEKRVAVGDEFLDVFGFDGELYVHVCRIP

SEQ ID NO: 7561 - DNA, 765 bp, Neisseria gonorrhoeae; identical to SEQ ID NO: 155

SEQ ID NO: 7562 - protein, 255 aa, Neisseria gonorrhoeae; identical to SEQ ID NO: 6148

SEQ ID NO: 7563 - DNA, 96 bp, Neisseria gonorrhoeae
atgattgggatgcccgacgcgtcggatggctgtgttttgccgtccgaatgtgatggaagcctgtccatactgaaaaaagtctataaaggagaaata

SEQ ID NO: 7564 - protein, 32 aa, Neisseria gonorrhoeae
MIGMPDASDGCVLPSECDGSLSILKKVYKGEI

SEQ ID NO: 7565 - DNA, 96 bp, Neisseria gonorrhoeae
atggacaggcttccatcacattcggacggcaaaacacagccatccgacgcgtcgggcatcccaatcattaaaaatatatgggaaaaattatcttat

SEQ ID NO: 7566 - protein, 32 aa, Neisseria gonorrhoeae
MDRLPSHSDGKTQPSDASGIPIIKNIWEKLSY

SEQ ID NO: 7567 - DNA, 405 bp, Neisseria gonorrhoeae
ccatcggacgcgctcggacaggccgttgcgccgcaacccctgcttttccaaacagtcgaaaccttcctgtttgaacctctcaaccaaaggtttgccgtcacgcgtacgccaatccaacccgcaggcttcaaacttccctattttcctataaaagtaagatttttgcgcggattcatattcgtttgccctgacggaacgattgccgtctgaaagcggtatctcgtagtcctctaaagacagcggactctcgccgccaatatcccaaaaatcgatggcggcaggttttctcggcttacaccagccggacaaggacgaacactcataccaccccgccagccggcagcctgcaaccgtaaatgcaaacaacgcagccgttgccgtatattttattacccgaatttccat

SEQ ID NO: 7568 - protein, 69 aa, Neisseria gonorrhoeae
PSDALGQAVAPQPLLFQTVETFLFEPLNQRFAVTRTPIQPAGFKLPYFPIKVRFLRGFIFVCPDGTIAV

SEQ ID NO: 7569 - DNA, 126 bp, Neisseria gonorrhoeae
atgggaaaaattatcttattgatatttaaaacgaatcaaagaaaaacagcagaccgttcggaattatgcggcaaaaccgcagacaagaagaaaacaaggggattattcagaaaagggaaaaacatc

SEQ ID NO: 7570 - protein, 42 aa, Neisseria gonorrhoeae
MGKIILLIFKTNQRKTADRSELCGKTADKKKTRGLFRKGKNI

SEQ ID NO: 7571 - DNA, 774 bp, Neisseria gonorrhoeae; identical to SEQ ID NO: 6179

SEQ ID NO: 7572 - protein, 258 aa, Neisseria gonorrhoeae; identical to SEQ ID NO: 6180

SEQ ID NO: 7573 - DNA, 96 bp, Neisseria gonorrhoeae
gtgggcattgaaattctggtatttgggctgattgattcgatattaaaaatgccgtctgaaaggttttcagacggcattttgtttgccagatatatt

SEQ ID NO: 7574 - protein, 32 aa, Neisseria gonorrhoeae
VGIEILVFGLIDSILKMPSERFSDGILFARYI

SEQ ID NO: 7575 - DNA, 684 bp, Neisseria gonorrhoeae
gccccttttcccgaaaatcgcgctgccgatacggacgtgtgtcgcaccgcactcaatggcggcaggcatatcgtccgacatccccatagacagcacgtccgccttaacgccagccgcattgaggtcggcaagcagcttttgcatggtctgaaactgagttttcaactccgtttcactgctgttggctttggcaacgcacatcagtccgcgcacgacaaggttgggcagcttcgccacttccacggcaagcgcgaccgcttcttcgggcgcgacaccgtgttttgccgcctcgcccgcaatgttcacctcgacacacacctgcaagggcggcattaaggagcgacgctgcctgctcagccggacggcggtcttcagacggcatacggtatgcacccaatgcgcgcgttcggcgacaaatttggttttgttggactgcacatcgccgatgacgtgccacacgatgtcggtcaaatccgccaattcctccgttttgccgtaccactcctgaatatagttctcgccgaaatcacgctgtccggcagcgtaaacttcgcggatgccgtctgaagggaaggtcttgctgacggcaatcaggctgacggaatgcggctccctgcccgcctgcagaaccaattttccgatacggtcggacacctcacgataacgttcttgcaacaccgtcat

SEQ ID NO: 7576 - protein, 111 aa, Neisseria gonorrhoeae
APFPENRAADTDVCRTALNGGRHIVRHPHRQHVRLNASRIEVGKQLLHGLKLSFQLRFTAVGFGNAHQSAHDKVGQLRHFHGKRDRFFGRDTVFCRLARNVHLDTHLQGRH

SEQ ID NO: 7577 - DNA, 1308 bp, Neisseria gonorrhoeae
atggatatttcaaaacaaacattgctggatagggtttttaacctgaaggcaaacggtacgacggtacgtaccgagttgatggcgggtttgacgacctttttgacgatgtgctacatcgttatcgtcaatcccctgattttgggcgagaccggaatggatatgggggcggtattcgtcgctacctgtatcgcatccgccatcggctgttttgtcatgggttttatcggcaactatccgattgcgcttgccccggggatggggctgaatgcctatttcacctttgccgtcgttaagggtatgggcgtgccttggcaggtggcgttgggtgcggtgttcatttccggtctgattttcatcctgttcagcttttttaaagtcagggaaatgctggtcaacgcactgcctatgggtttgaaaatgtcgattgccgccggtatcggtttgtttttggcactgatttccctgaaaggcgcaggcattatcgttgccaatccggcaaccttggtcggcttgggcgatattcatcagcccagcgcactgttggcattgttcggttttgtcatggtggtcgtattggggtatttccgcgttcaaggcgcaatcatcatcaccattctgacgattaccgtcattgccagcctgatgggtttgaacgagtttcacggcgtggtcggcgaagtaccgggcattgcgccgacctttatgcagatggattttaaaggtctgtttaccgtcagcatggtcagcgtgattttcgtcttcttcttggtcgatttgttcgacagtaccggaacgctggtcggcgtatcccaccgtgccggactgctggtggacggtaagctgccccgcctgaaacgcgcactgcttgcagactctaccgccattgtggcaggtgcggctttgggtacttcttcaaccacgccttatgtggaaagcgcggcgggcgtatcggcaggcggacggaccggcctgacggcggttaccgtcggcgtattgatgctggcgtgtctgatgttctccccattggcgaaaagtgttccggtatttgccaccgcgcccgcactgctttatgtcggcacgcagatgctccgcagtgcgagggacattgattgggacgatatgactgaagccgcgcccgcgttcctgaccattgtcttcatgccgtttacctattcgattgcagacggcatcgccttcggcttcatcagctatgccgtggtcaaacttttgtgtcgccggactggggacgtgccgcctatggtatgggttgttgccgtattgtgggcattgaaattctggtatttgggc

SEQ ID NO: 7578 - protein, 436 aa, Neisseria gonorrhoeae
MDISKQTLLDRVFNLKANGTTVRTELMAGLTTFLTMCYIVIVNPLILGETGMDMGAVFVATCIASAIGCFVMGFIGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFVMVVVLGYFRVQGAIIITILTITVIASLMGLNEFHGVVGEVPGIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPVFATAPALLYVGTQMLRSARDIDWDDMTEAAPAFLTIVFMPFTYSIADGIAFGFISYAVVKLLCRRTGDVPPMVWVVAVLWALKFWYLG

SEQ ID NO: 7579 - DNA, 1041 bp, Neisseria gonorrhoeae
atgcagattaccgacttactcgccttcggcgctaaaaacaaagcatccgaccttcacctgagttcgggcatatcccctatgattcgggttcacggcgacatgcggcgcatcaaccttcccgaaatgagcgcggaagaggtcggcaatatggtaacttcggtgatgaacgaccaccagcggaaaatctaccagcaaaacttggaagtcgacttctcgttcgaactgcccaacgtcgcccgattccgcgtcaacgccttcaacaccggccgcggccccgccgccgtattccgcaccattcccagcaccgtcttatcgctggaagaattgaaagccccgagcattttccaaaaaatcgcagaatcgccgcgcggcatggtattggttaccggccctaccggttcgggcaaatcgaccacgcttgccgcgatgatcaactacatcaacgaaacccagccggcacacatcctgaccatcgaagacccgatcgaattcgtccaccaaagcaaaaaatccctgattaaccaacgcgagctgcaccagcacaccctcagcttcgccaacgcgctgagttccgcattgcgcgaagaccccgacgttatccttgtcggcgagatgcgcgaccccgaaaccatcggcttggcactgaccgccgccgaaaccggacacttggttttcggcacgctgcacacgaccggcgcggcaaaaaccgtcgaccgtatcgtggacgtattccccgccggagagaaagaaatggtgcgttccatgctgtccgaatcgctgaccgccgtcatctcccaaaacctgctgaaaacgcacgacggcgacggccgtgtcgcctcgcacgaaatcctgattgccaaccccgccgtccgcaacctcatccgcgaaaacaaaatcacgcagattaactccgtcctgcaaaccgggcgggcgagcggtatgcagacgatggaccaatcgctgcaatcgctggtgcgccaagggctgatcgcaccggaagccacacgcagacgcgcgcaaaacagcgaaagtatgagtttc

SEQ ID NO: 7580 - protein, 347 aa, Neisseria gonorrhoeae
MQITDLLAFGAKNKASDLHLSSGISPMIRVHGDMRRINLPEMSAEEVGNMVTSVMNDHQRKIYQQNLEVDFSFELPNVARFRVNAFNTGRGPAAVFRTIPSTVLSLEELKAPSIFQKIAESPRGMVLVTGPTGSGKSTTLAAMINYINETQPAHILTIEDPIEFVHQSKKSLINQRELHQHTLSFANALSSALREDPDVILVGEMRDPETIGLALTAAETGHLVFGTLHTTGAAKTVDRIVDVFPAGEKEMVRSMLSESLTAVISQNLLKTHDGDGRVASHEILIANPAVRNLIRENKITQINSVLQTGRASGMQTMDQSLQSLVRQGLIAPEATRRRAQNSESMSF

SEQ ID NO: 7581 - DNA, 93 bp, Neisseria gonorrhoeae; identical to SEQ ID NO: 6239

SEQ ID NO: 7582 - protein, 31 aa, Neisseria gonorrhoeae; identical to SEQ ID NO: 6240

SEQ ID NO: 7583 - DNA, 108 bp, Neisseria gonorrhoeae; identical to SEQ ID NO: 6257

SEQ ID NO: 7584 - protein, 36 aa, Neisseria gonorrhoeae; identical to SEQ ID NO: 6258

SEQ ID NO: 7585 - DNA, 1176 bp, Neisseria gonorrhoeae
atggaatttgtttacgacgtggcagaatcggcagtcagccctgcggtaattaaagtaatcggcttgggcggcggcggttgcaatgcaatcaataacatggttgccaacaatgtgcgcagtgtggagtttatcagtgccaatacagatgcgcagtctttggcaaaaaaccatgcggcgaagagaatccagttgggtacgaatctgacacgcggtttgggcgcgggtgcgaatcccgatatcggccgtgcggcagcacaggaagatcgggaggccattgaagaagccattcgcggtgccaatatgctgtttatcacgaccggtatgggcggcggtaccggtaccggttccgcgccggttgttgctgagattgccaagtctttgggcattctgaccgttgccgtagttacccgtccgttttcttatgaaggcaaacgcgtccatgtggcacaggcagggttggaacagttgaaagaatacgtcgattcgctgattatcatcccgaacgacaaactgatgaccgcattgggtgaagacgtaactatgcgcgaagccttccgcgcggcggacaatgtattgcgcgatgcggtcgcaggcatttccgaagtggtaacttgcccgagcgaaatcatcaacctcgactttgccgacgtgaaaaccgtgatgagcaaccgcggtatcgctatgatgggttcgggttatgcccaaggtatcgaccgtgcgcgtatggcgaccgaccaggccatttccagtccgttgctggacgatgtaactttggatggtgcacgcggtgtgctggtcaatattacgactgctccgggttgcctgaaaatgtccgagttgtctgaagtcatgaaaatcgtcaaccaaagcgcgcatcccgatttggaatgcaaattcggtgccgctgaagacgagaccatgagcgaagatgccatccggattaccattatcgctaccggtctgaaagaaaaaggagcggtcgatcctactccggcaagggaagtagaagcggttgccccgtccaaacaggagcaaagccacaatgtcgaaggtatgatccgcaccaatcgcggtatccgcaccatgaatctgacagcagcggatttcgataaccagtctgtccttgacgattttgaaattcctgcaattttgcgtcgtcaacacaattcagacaaa

SEQ ID NO: 7586 - protein, 392 aa, Neisseria gonorrhoeae
MEFVYDVAESAVSPAVIKVIGLGGGGCNAINNMVANNVRSVEFISANTDAQSLAKNHAAKRIQLGTNLTRGLGAGANPDIGRAAAQEDREAIEEAIRGANMLFITTGMGGGTGTGSAPVVAEIAKSLGILTVAVVTRPFSYEGKRVHVAQAGLEQLKEYVDSLIIIPNDKLMTALGEDVTMREAFRAADNVLRDAVAGISEVVTCPSEIINLDFADVKTVMSNRGIAMMGSGYAQGIDRARMATDQAISSPLLDDVTLDGARGVLVNITTAPGCLKMSELSEVMKIVNQSAHPDLECKFGAAEDETMSEDAIRITIIATGLKEKGAVDPTPAREVEAVAPSKQEQSHNVEGMIRTNRGIRTMNLTAADFDNQSVLDDFEIPAILRRQHNSDK

SEQ ID NO: 7587 - DNA, 1200 bp, Neisseria gonorrhoeae
gtgttgacgacgcaaaattgcaggaatttcaaaatcgtcaaggacagactggttatcgaaatccgctgctgtcagattcatggtgcggataccgcgattggtgcggatcataccttcgacattgtggctttgctcctgtttggacggggcaaccgcttctacttcccttgccggagtaggatcgaccgctcctttttctttcagaccggtagcgataatggtaatccggatggcatcttcgctcatggtctcgtcttcagcggcaccgaatttgcattccaaatcgggatgcgcgctttggttgacgattttcatgacttcagacaactcggacattttcaggcaacccggagcagtcgtaatattgaccagcacaccgcgtgcaccatccaaagttacatcgtccagcaacggactggaaatggcctggtcggtcgccatacgcgcacggtcgataccttgggcataacccgaacccatcatagcgataccgcggttgctcatcacggttttcacgtcggcaaagtcgaggttgatgatttcgctcgggcaagttaccacttcggaaatgcctgcgaccgcatcgcgcaatacattgtccgccgcgcggaaggcttcgcgcatagttacgtcttcacccaatgcggtcatcagtttgtcgttcgggatgataatcagcgaatcgacgtattctttcaactgttccaaccctgcctgtgccacatggacgcgtttgccttcataagaaaacggacgggtaactacggcaacggtcagaatgcccaaagacttggcaatctcagcaacaaccggcgcggaaccggtaccggtaccgccgcccataccggtcgtgataaacagcatattggcaccgcgaatggcttcttcaatggcctcccgatcttcctgtgctgccgcacggccgatatcgggattcgcacccgcgcccaaaccgcgtgtcagattcgtacccaactggattctcttcgccgcatggttttttgccaaagactgcgcatctgtattggcactgataaactccacactgcgcacattgttggcaaccatgttattgattgcattgcaaccgccgccgcccaagccgattactttaattaccgcagggctgactgccgattctgccacgtcgtaaacaaattccattcaaaaactcctgatcgccccgttcagaggacggtt

SEQ ID NO: 7588 - protein, 400 aa, Neisseria gonorrhoeae
VLTTQNCRNFKIVKDRLVIEIRCCQIHGADTAIGADHTFDIVALLLFGRGNRFYFPCRSRIDRSFFFQTGSDNGNPDGIFAHGLVFSGTEFAFQIGMRALVDDFHDFRQLGHFQATRSSRNIDQHTACTIQSYIVQQRTGNGLVGRHTRTVDTLGITRTHHSDTAVAHHGFHVGKVEVDDFARASYHFGNACDRIAQYIVRRAEGFAHSYVFTQCGHQFVVRDDNQRIDVFFQLFQPCLCHMDAFAFIRKRTGNYGNGQNAQRLGNLSNNRRGTGTGTAAHTGRDKQHIGTANGFFNGLPIFLCCRTADIGIRTRAQTACQIRTQLDSLRRMVFCQRLRICIGTDKLHTAHIVGNHVIDCIATAAAQADYFNYRRADCRFCHVVNKFHSKTPDRPVQRTV

SEQ ID NO: 7589 - DNA, 144 bp, Neisseria gonorrhoeae
atggggatgtggcgggcggcagaaatcatcaatgctgccgactgccatacttctgaaatctatagtggtttaaatttaaaccggtacagcgttgcctcgccttgccgtacttcttgtactgtctgcggcttcgtcgccttgtcc

SEQ ID NO: 7590 - protein, 48 aa, Neisseria gonorrhoeae
MGMWRAAEIINAADCHTSEIYSGLNLNRYSVASPCRTSCTVCGFVALS

SEQ ID NO: 7591 - DNA, 1224 bp, Neisseria gonorrhoeae
atgaataccgataacctgcacgacatcttggacgaaacggttcaagtgtattctcaaaaaaaacaaagccgatccgaaaccccggccgaaatcggcacacacttccacccgctgctcgaccgcctgtgcgaaaccgcagaagcacaaaacgcgtccgacatccttatcagcaaaggattcccgccctcgttgaaaatcaacagcgcattaaccccgcagccgcaaaaggctctgacgggcgaggaaaccgccgccatcgccgcatcgacgatgaacgccgaacaatcggaaatattccggcgcgacggcgaaatcaactactccgtccaatcgcgcagcggcacgcgctaccgcgccaacgcctactacagccaaggcagcgcaggtttggttttgcggcgcatcaaccacgtcatcccgcaaatgcgggaattgggcttgcccgaaaaactcaaagacctcgccgtcgcaccgcgcgggctgctgattatcgtcgggcctaccggttcgggcaaatccaccacgatggcgactatgctcgaacaccgcaacaaaaccctgcccggccatatcgttaccatcgaagacccgattgagtttatctacaaaccgcgccgctgcatctttacccagcgcgaaatcggcgtcgacaccataaactggcagacggcggtacaaaacgctatgcgccaatccccagacgtggtctgtatcggcgaagtccgcagcagggaaagtatggaatacgcgatgcagctcgcccaaaccggccacctgtgcatttttacgctccacgccaacaccgcgccgcagtcgctcgaacgcatactcaacttctaccccaaagaacagcacaaccaaatactgattgacatcgccctcaatctgaccggcatcatctgccaacgcctcgccctcaaaaaagacaaaacgggcaggacggcggttgtcgacttgctcatcaacacgcccgccatccaggacttcatcctgaagggcgacctgatgaacatcagtaaaatcatggaaaccgccaaaaccgacggaatgcagacgatggaccaaaaccttttcgaactgtaccgtcacggcatcatcagttacgaagaagccctgcgccagtccgtttccgccaacaacctgcgattgcacatccaactgcacaaagaaggcaaaacgcccgaactcctttacgacagggtcaacggtctcaacctcatttcc

SEQ ID NO: 7592 - protein, 408 aa, Neisseria gonorrhoeae
MNTDNLHDILDETVQVYSQKKQSRSETPAEIGTHFHPLLDRLCETAEAQNASDILISKGFPPSLKINSALTPQPQKALTGEETAAIAASTMNAEQSEIFRRDGEINYSVQSRSGTRYRANAYYSQGSAGLVLRRINHVIPQMRELGLPEKLKDLAVAPRGLLIIVGPTGSGKSTTMATMLEHRNKTLPGHIVTIEDPIEFIYKPRRCIFTQREIGVDTINWQTAVQNAMRQSPDVVCIGEVRSRESMEYAMQLAQTGHLCIFTLHANTAPQSLERILNFYPKEQHNQILIDIALNLTGIICQRLALKKDKTGRTAVVDLLINTPAIQDFILKGDLMNISKIMETAKTDGMQTMDQNLFELYRHGIISYEEALRQSVSANNLRLHIQLHKEGKTPELLYDRVNGLNLIS

SEQ ID NO: 7593 - DNA, 1242 bp, Neisseria gonorrhoeae
atggaacagcagaaaagatacatcagcgtactggatatcggtacgtctaaagtcctcgcactgatcggggaagttcaagatgacgacaaaatcaacatcatcggtttggggcaggctccttcacggggcttgcgcgcgggcatggtaaccaatatcgatgccaccgtccaagccatcaggcaggcggtcaatgatgccgagctgatggcggataccaaaattacccacgttaccacaggtatcgcaggcaaccacatccgcagccttaattcgcaaggtgtggttaaaatcaaagacggagaagtaacacaggcagacatcgaccgcgccattgaaacggcaaaggcaatcaatatcccgcccgatcaaaaaattctcgatgccgtggttcaagactacattatcgacacccaacttggtgtaagggagcccatcggtatgagcggtgtgcgtctggatacgcgggtgcacatcattaccggtgcaagtacggcagtgcagaatgtccaaaaatgtatcgagctgtgcggcttgaaaagcgatcagatcatgcttcaaccgttggcaagcgggcaggcggtgctgactgaagatgaaaaagacctcggcgtatgcgtcatcgacattggtggcggaacgaccgatattgccgtttatatgaacggcgccatccgccatacgtccgtcattccggccggtggtaatctgattaccaaagatttgtccaaatcgttgagaacacctctcgatgccgccgagtacattaaaatccattatggcgtggcatcatgcgatacggaaggcttgggcgagatgattgaagttccgggcgtgggtgaccggacatcgcgtcaggtttccagtaaggttttggcagcaatcatcagcgcacgtattcaggagatttttggcgtagtgctgggcgaactgcaaaaatcgggtttccccaaagaagtgctgaatgcgggtatcgttctgaccggcggtgtgtccatgatgaccgggattgtggaatttgccgaaaaaatcttcgatttgcctgtacgcaccggtgcgccccaagaaatgggcggtttgtccgaccgtgtccgcacaccgcgcttttctaccgctatcgggctgcttcatgcagcatgcaagctggaaggaaacttgccgcaaccggaaaacggtacagtgcaagagagagaagggggcggcggtttgttggcaagattgaagcggtggattgaaaacaacctc

SEQ ID NO: 7594 - protein, 414 aa, Neisseria gonorrhoeae
MEQQKRYISVLDIGTSKVLALIGEVQDDDKINIIGLGQAPSRGLRAGMVTNIDATVQAIRQAVNDAELMADTKITHVTTGIAGNHIRSLNSQGVVKIKDGEVTQADIDRAIETAKAINIPPDQKILDAVVQDYIIDTQLGVREPIGMSGVRLDTRVHIITGASTAVQNVQKCIELCGLKSDQIMLQPLASGQAVLTEDEKDLGVCVIDIGGGTTDIAVYMNGAIRHTSVIPAGGNLITKDLSKSLRTPLDAAEYIKIHYGVASCDTEGLGEMIEVPGVGDRTSRQVSSKVLAAIISARIQEIFGVVLGELQKSGFPKEVLNAGIVLTGGVSMMTGIVEFAEKIFDLPVRTGAPQEMGGLSDRVRTPRFSTAIGLLHAACKLEGNLPQPENGTVQEREGGGGLLARLKRWIENNL

SEQ ID NO: 7595 - DNA, 207 bp, Neisseria gonorrhoeae
gtgtccggtaatttcagcacagaatattcaataagacaatatgttcttttgaaaaatacttttggttttttcaccgaagacaggccggttcaagctgcggaaattgtttgcaattatttaaaagcagaggcggaggtcacaatgaaatgtccgaatggggatgtggcgggcggcagaaatcatcaatgctgccgactgccatacttc

SEQ ID NO: 7596 - protein, 69 aa, Neisseria gonorrhoeae
VSGNFSTEYSIRQYVLLKNTFGFFTEDRPVQAAEIVCNYLKAEAEVTMKCPNGDVAGGRNHQCCRLPYF

SEQ ID NO: 7597 - DNA, 1035 bp, Neisseria gonorrhoeae
ttgggtatgctgttcggcgcgtccatcggacgcgaaggcccgtccgtgcaggtcggcgcggcagtaatgggcgcgtggggcgcgtggtgcaaaaaacacggtttggcgtttaagggtatgcaggaaaacgatttgatggcggcgggcgcggcgggcggtttggcagcagcgttcaacgcgccgctggcgggcgtgattttcgccattgaggaactggggcgcggcatcatgctgcgctgggagcggcagattctgctcggcgtactcgccgccggtttcatacaggtcgccattcagggcaacaacccgtatttttcgggtttcaacggcggcgttttggaaaatattttgatgtggatcgtggcggcggggctggtttgcggcgcggctggcggcatatttgcccgtatgctctatcgcggtgcggcggcgtttgcaccgcgcaagatacgcggcttcatccgcaaccgtccgctgctgctggcggcactgatggggctgctgctcgccctgctcggcacgttctaccaaggcaaaacctacggcaccggctaccacgaagccgcccaagccctgcacggcatctacgaagcccccgtcggactcgccgccgccaaatggctcgccaccgtattcagctattgggcaggcattccgggcggcattttcactccctcgctgaccataggtgcggttttgggcgagcatatcgccgccatcgccgacatatcgcagggtgcaaacatcatcgtcctcatctgcatggcggcatttttagcgggcgcgacacaatcgccgattacttccgccgtcgtcgtcatggaaatgaccggcgggcaaagcctgctgttttggatgctgattgcctgcattttcgcctcgcaggtttcgcgccagttttcgccgcgtccgttctaccacgcatcgggaatgcgcttccgccggcgcgtgcttcaggaaaccgccgcccaaaccggcaatgcgcccgcaagaccgcaagccgcaaacagcaaaacgggaatgccgtctgaaaat

SEQ ID NO: 7598 - protein, 345 aa, Neisseria gonorrhoeae
LGMLFGASIGREGPSVQVGAAVMGAWGAWCKKHGLAFKGMQENDLMAAGAAGGLAAAFNAPLAGVIFAIEELGRGIMLRWERQILLGVLAAGFIQVAIQGNNPYFSGFNGGVLENILMWIVAAGLVCGAAGGIFARMLYRGAAAFAPRKIRGFIRNRPLLLAALMGLLLALLGTFYQGKTYGTGYHEAAQALHGIYEAPVGLAAAKWLATVFSYWAGIPGGIFTPSLTIGAVLGEHIAAIADISQGANIIVLICMAAFLAGATQSPITSAVVVMEMTGGQSLLFWMLIACIFASQVSRQFSPRPFYHASGMRFRRRVLQETAAQTGNAPARPQAANSKTGMPSEN

SEQ ID NO: 7599 - DNA, 147 bp, Neisseria gonorrhoeae
taccctccggccggcatttgacccgcaacaatatcctgcaagatttattgtgtgcgcataaatgccggacagccgcctaaataaggtataatcgcatccgattctgtcccgtttgccgcccgcaggcgggatgtcggcggttttcat

SEQ ID NO: 7600 - protein, 6 aa, Neisseria gonorrhoeae
YPPAGI

SEQ ID NO: 7601 - DNA, 135 bp, Neisseria gonorrhoeae
atggggtttcagattgtgggcattatcagtattttctatttggcaatgtcttttactgattttgtcaaaacgcatttatgccgtctgaaaagcttcagacgggattttcgtttggactcgattactcgatataag

SEQ ID NO: 7602 - protein, 45 aa, Neisseria gonorrhoeae
MGFQIVGIISIFYLAMSFTDFVKTHLCRLKSFRRDFRLDSITRYK

SEQ ID NO: 7603 - DNA, 1389 bp, Neisseria gonorrhoeae; identical to SEQ ID NO: 6351

SEQ ID NO: 7604 - protein, 463 aa, Neisseria gonorrhoeae; identical to SEQ ID NO: 6352

SEQ ID NO: 7605 - DNA, 726 bp, Neisseria gonorrhoeae
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaaggcattgggcagtttggcgaaagaatacatccatgggaatattttgaggacggacatcaatggcgcacaggaagcctaccgccggtatccgtggattgcgtcggtcatggtgcgccgccgttttcccgatacggttgaggtcgtcctgaccgagcgcaagccggttgcacgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggaatgtcgttttggacaacggcatcaccgtcaggctcggacgggaaaacgagatgaaacgcctccggctttttaccgaagcgtggcagcatctgttgcgtaagaataaaaatcggttatcctatgtggatatgaggtataaggacggattttcagtccgccatgctcccgacggtttacccgaaaaagaatccgaagaa

SEQ ID NO: 7606 - protein, 242 aa, Neisseria gonorrhoeae
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWNVVLDNGITVRLGRENEMKRLRLFTEAWQHLLRKNKNRLSYVDMRYKDGFSVRHAPDGLPEKESEE

SEQ ID NO: 7607 - DNA, 666 bp, Neisseria gonorrhoeae
atgctgccacgcttcggtaaaaagccggaggcgtttcatctcgttttcccgtccgagcctgacggtgatgccgttgtccaaaacgacattccacgccgaacgtgccgtataggtcatctctttgatgcccaaaccctgttttgccaaaacagtcgaaaattcgtcataacggcggagcatttcggcagacgttccttccgcgcctctgaataccggcattccgggtctgtccaagcgggcttcaaaaacattgccttcgccgtccaccaaggcatggtcgccccaacgtgcaaccggcttgcgctcggtcaggacgacctcaaccgtatcgggaaaacggcggcgcaccatgaccgacgcaatccacggataccggcggtaggcttcctgtgcgccattgatgtccgtcctcaaaatattcccatggatgtattctttcgccaaactgcccaatgccttcttatcggaataaaccaggttgcccttcagcgacacctgcttgacgggcagatgattcgaattgtaaaaccaaaccagcccggacgcagcaagcagcatcgccatcatgacaagcagccagcgcgtcagccgttccatcgcttcggcattatcccacatgtgcggccttcaaaatttcaatacataaatcggcaaaacccacgcccg

SEQ ID NO: 7608 - protein, 222 aa, Neisseria gonorrhoeae
MLPRFGKKPEAFHLVFPSEPDGDAVVQNDIPRRTCRIGHLFDAQTLFCQNSRKFVITAEHFGRRSFRASEYRHSGSVQAGFKNIAFAVHQGMVAPTCNRLALGQDDLNRIGKTAAHHDRRNPRIPAVGFLCAIDVRPQNIPMDVFFRQTAQCLLIGINQVALQRHLLDGQMIRIVKPNQPGRSKQHRHHDKQPARQPFHRFGIIPHVRPSKFQYINRQNPRP

SEQ ID NO: 7609 - DNA, 156 bp, Neisseria gonorrhoeae
tttcctgatccgcaaaacccaatgccgtctgaaaaccgcatccccgttttcagacggcatgattttatccgccccattcatgtgccacactttattcacttcataacaataaaccggtaaaaccatgaaaaccccactcctcaagcctctgctcat

SEQ ID NO: 7610 - protein, 39 aa, Neisseria gonorrhoeae
FPDPQNPMPSENRIPVFRRHDFIRPIHVPHFIHFITINR

SEQ ID NO: 7611 - DNA, 2040 bp, Neisseria gonorrhoeae
atgcccttcgtactcggcatcatcgccggcggcctggtcgatttggacaaccgcctgaccggacggctgaaaaacatcatcgccaccgtcgccctgtttaccctctcctcgctcacggcgcaaagcaccctcggcacagggctgcccttcatcctcgccatgaccctgatgaccttcggctttaccattttaggcgcggtcgggctgaaataccgcaccttcgccttcggcgcactcgccgtcgccacctacaccacgcttacctacacccccgaaacctactggctgaccaaccccttcatgattttatgcggcaccgtactgtacagcaccgccatcatcctgttccaaatcatcctgccccaccgccccgtccaagaaagcgtcgccaatgcctacgaagcactcggcggctacctcgaagccaaagccgacttcttcgaccccgatgaggcagcctggataggcaaccgccacatcgacctcgccatgagcaacaccggcgtcatcaccgccttcaaccaatgccgttccgccctgttttaccgtttgcgcggcaaacaccgccacccgcgcaccgccaaaatgctgcgctactacttcgccgcccaagacatccacgaacgcatcagctccgcccacgtcgactaccaagagatgtccgaaaaattcaaaaacaccgacatcatcttccgcatccgccgcctgctcgaaatgcaggggcaggcgtgccgcaacaccgcccaagccatccggtcgggcaaagactacgtttacagcaaacgcctcggacgcgccatcgaaggctgccgccagtcgctgcgcctcctttcagacggcaacgacagtcccgacatccgccacctgagccgccttctcgacaacctcggcagcgtcgaccagcagttccgccaactccgacacagcgactcccccgccgaaaacgaccgcatgggcgacacccgcatcgccgccctcgaaaccggcagcttcaaaaacacctggcaggcaatccgtccgcagctgaacctcgaatcatgcgtattccgccatgccgtccgcctgtccctcgtcgttgccgccgcctgcaccatcgtcgaagccctcaacctcaacctcggctactggatactgctgaccgcccttttcgtctgccaacccaactacaccgccaccaaaagccgcgtgtaccaacgcatcgccggcaccgtactcggcgtaatcgtcggctcgctcgtcccctacttcaccccctccgtcgaaaccaaactctggattgtcatcgccggtaccaccctgttcttcatgacccgcacctacaaatacagtttctccaccttcttcatcaccattcaggcactgaccagcctctccctcgcaggtttggacgtatacgccgccatgcccgtgcgcatcatcgacaccattatcggcgcatcccttgcctgggcggcggtcagctacctgtggccagactggaaatacctcacgctcgaacgcaccgccgcccttgccgtatgcagcagcggcacatacctccaaaaaattgccgaacgcctcaaaaccggcgaaaccggcgacgacatagaataccgcatcacccgccgccgcgcccacgaacacaccgccgccctcagcagcaccctttccgacatgagcagcgaacccgcaaaattcgccgacagcctgcaacccggctttaccctgctcaaaaccggctacgccctgaccggctacatctccgccctcggcgcataccgcagcgaaatgcacgaagaatgcagccccgactttaccgcacagttccaccttgccgccgaacacaccgcccacatcttccaacacctgcccgacatgggacccgacgactttcagacggcattggatacactgcgcggcgaactcggcaccctccgcacccgcagcagcggaacacaaagccacatcctcctccaacagctccaactcatcgcccggcaactcgaaccctactaccgcgcctaccgacaaattccgcacaggcagccccaaaacgcagcc

SEQ ID NO: 7612 - protein, 680 aa, Neisseria gonorrhoeae
MPFVLGIIAGGLVDLDNRLTGRLKNIIATVALFTLSSLTAQSTLGTGLPFILAMTLMTFGFTILGAVGLKYRTFAFGALAVATYTTLTYTPETYWLTNPFMILCGTVLYSTAIILFQIILPHRPVQESVANAYEALGGYLEAKADFFDPDEAAWIGNRHIDLAMSNTGVITAFNQCRSALFYRLRGKHRHPRTAKMLRYYFAAQDIHERISSAHVDYQEMSEKFKNTDIIFRIRRLLEMQGQACRNTAQAIRSGKDYVYSKRLGRAIEGCRQSLRLLSDGNDSPDIRHLSRLLDNLGSVDQQFRQLRHSDSPAENDRMGDTRIAALETGSFKNTWQAIRPQLNLESCVFRHAVRLSLVVAAACTIVEALNLNLGYWILLTALFVCQPNYTATKSRVYQRIAGTVLGVIVGSLVPYFTPSVETKLWIVIAGTTLFFMTRTYKYSFSTFFITIQALTSLSLAGLDVYAAMPVRIIDTIIGASLAWAAVSYLWPDWKYLTLERTAALAVCSSGTYLQKIAERLKTGETGDDIEYRITRRRAHEHTAALSSTLSDMSSEPAKFADSLQPGFTLLKTGYALTGYISALGAYRSEMHEECSPDFTAQFHLAAEHTAHIFQHLPDMGPDDFQTALDTLRGELGTLRTRSSGTQSHILLQQLQLIARQLEPYYRAYRQIPHRQPQNAA

SEQ ID NO: 7613 - DNA, 1257 bp, Neisseria gonorrhoeae; identical to SEQ ID NO: 6395

SEQ ID NO: 7614 - protein, 419 aa, Neisseria gonorrhoeae; identical to SEQ ID NO: 6396

SEQ ID NO: 7615 - DNA, 912 bp, Neisseria gonorrhoeae
atgcagaattttggcaaagtggccgtattgatgggtggtttttccagcgaacgagaaatctcgctggacagcggtaccgccattttgaacgccttaaaaagcaaaggcatagacgcatacgccttcgaccctaaggaaacgccgttatccgaactgaaggagcggggctttcagacggcattcaacatccttcacggtacttacggcgaagacggggctgttcagggtgcattggaactgttgggcattccctataccggcagcggtgtcgccgcctccgccatcggcatggacaaataccgctgcaaactgatttggcaggcattgggattacccgttcccgagttcgccgtactgtacgatgataccgatttcgatgccgtcgaagaaaaattgggtctgccgatgtttgtgaagccggcggccgaaggcagcagcgtcggcgtggtaaaagtcaaagaaaaaggccgtctgaaaagcgtttacgaagaattgaaacaccttcagggcgaaatcattgccgaacgttttatcggcggcggcgaatattcctgccccgtcctgaacggcaaagggctgcccggcatacacatcatccccgcaaccgagttttacgactacgaagccaagtacaaccgagacgacaccatttatcaatgtccttcggaagatttgaccgaagccgaagaaagcctgatgcgcgaactggcggttcgcggcgcacaggcaatcggtgcggaaggctgcgtgcgcgtcgatttcctcaaagataccgacggcaaactctatctgttggaaatcaacaccctgcccggtatgaccggccatagtttagtaccgaaatccgctgccgttacgggcgtgggttttgccgatttatgtattgaaattttgaaggccgcacatgtggga

SEQ ID NO: 7616 - protein, 304 aa, Neisseria gonorrhoeae
MQNFGKVAVLMGGFSSEREISLDSGTAILNALKSKGIDAYAFDPKETPLSELKERGFQTAFNILHGTYGEDGAVQGALELLGIPYTGSGVAASAIGMDKYRCKLIWQALGLPVPEFAVLYDDTDFDAVEEKLGLPMFVKPAAEGSSVGVVKVKEKGRLKSVYEELKHLQGEIIAERFIGGGEYSCPVLNGKGLPGIHIIPATEFYDYEAKYNRDDTIYQCPSEDLTEAEESLMRELAVRGAQAIGAEGCVRVDFLKDTDGKLYLLEINTLPGMTGHSLVPKSAAVTGVGFADLCIEILKAAHVG

SEQ ID NO: 7617 - DNA, 1878 bp, Neisseria gonorrhoeae; identical to SEQ ID NO: 6425

SEQ ID NO: 7618 - protein, 626 aa, Neisseria gonorrhoeae; identical to SEQ ID NO: 6426

SEQ ID NO: 7619 - DNA, 1518 bp, Neisseria gonorrhoeae
atgttttttatttcaatccgctatatatttgtcagaaaactatggtgcgcaaacggtcagacctttaaaataacgcctttacgcactaaaaaccaaccggaacgcaacattatgatgaaaaatcgagtaagcaacatccattttgtcggtatcggcggcgtcggcatgagcggtatcgccgaagtcttgcacaatttgggctttaaagtttccggttcggatcaggcgcgaaatgccgctaccgagcatttgagcagcctgggcattcaagtttatcccggccataccgcagaacacgttaacggtgcggatgtcgtcgttgcctctaccgccgtcaagaaagaaaatcccgaagttgtcgctgcgttggagcggcaaattcccgttattccgcgcgccttgatgctggcagagctgatgcgcttccgtgacggcatcgccattgccggtacgcacggcaaaaccacgaccaccagcctgaccgcctccatcctcggcgcggcaggactcgaccccactttcgttatcggcggcaaactcaacgccgcaggcaccaacgcccgcttgggcaaaggcgaatacatcgttgccgaagccgacgaatccgatgcctctttcctacatctgaccccgattatgtccgtcgttaccaatatcgacgaagaccatatggatacctacgggcacagcgtcgaaaaactgcatcaggcgtttatcgatttcatccaccgtatgcccttctacggcaaagcctttttgtgtgttgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgctttgctggtggacgattacggacaccaccccgtcgaaatggcggcaacccttgccgctgcacgcggcgcgtatccggaaaaacgtttggtgctcgccttccagccgcaccgctatacccgcacgcgcgatttgtttgaagactttaccaaagtactcaataccgttgatgcgctggtactgaccgaagtttatgccgccggcgaagagccggttgccgccgccgactcccgcgccttggcgcgtgctatccgcgtattgggcaaacttgagccgatttactgcgaaaacgtcgccgacctgccgcaaatgctgatgaatgttttacaggatggcgatgttgtgttgaatatgggtgcgggaagcatcaaccgcgttccctccgcgctgttggaattgtcgaaacagatt

SEQ ID NO: 7620 - protein, 506 aa, Neisseria gonorrhoeae
MFFISIRYIFVRKLWCANGQTFKITPLRTKNQPERNIMMKNRVSNIHFVGIGGVGMSGIAEVLHNLGFKVSGSDQARNAATEHLSSLGIQVYPGHTAEHVNGADVVVASTAVKKENPEVVAALERQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCVDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYPEKRLVLAFQPHRYTRTRDLFEDFTKVLNTVDALVLTEVYAAGEEPVAAADSRALARAIRVLGKLEPIYCENVADLPQMLMNVLQDGDVVLNMGAGSINRVPSALLELSKQI

SEQ ID NO: 7621 - DNA, 282 bp, Neisseria gonorrhoeae
aataatatcaaaccataaatcccgccaagaaacattattttcttcaatcagttgcaatttccaagccctgttccatttcttcaactgtttttcccgagtaattgcgctctccatcgtaggatgcagttcataccaaaccggcatagtaacgttgtaccgtgatgtaaatccttcaatcaaatgctccctatgttggtaaatacgttgcaccaaatcagatgtaacgccaatgtataacgtgccattacgttggcttgctaaaatataaaccgcaggctgcat

SEQ ID NO: 7622 - protein, 5 aa, Neisseria gonorrhoeae
NNIKP

SEQ ID NO: 7623 - DNA, 237 bp, Neisseria gonorrhoeae
ttgctaaaatataaaccgcaggctgcatataatacccttttgaattatttaaatttatattcccgcgaacaccatccggtgattactttaacccttcgttatccccatagctttccatcattcccgcaactcttcgtcattcccgcgaaagcgggaatccaggactcaggacctgagaaacctttttacccgataagtttccgcaccgacagacccggattcccgcctgagcgggaa

SEQ ID NO: 7624 - protein, 79 aa, Neisseria gonorrhoeae
LLKYKPQAAYNTLLNYLNLYSREHHPVITLTLRYPHSFPSFPQLFVIPAKAGIQDSGPEKPFYPISFRTDRPGFPPERE

SEQ ID NO: 7625 - DNA, 885 bp, Neisseria gonorrhoeae; identical to SEQ ID NO: 6465

SEQ ID NO: 7626 - protein, 295 aa, Neisseria gonorrhoeae; identical to SEQ ID NO: 6466

SEQ ID NO: 7627 - DNA, 1065 bp, Neisseria gonorrhoeae
atgggcggtaaaacctttatgctgatggcgggcggaacgggcggacacattttcccagctctggctgtggcggattcattgcgcgtgcgcggtcatcatgtaatttggctgggcagcaaggattcgatggaagagcgcatcgtgccgcaatacggcatacgcttggaaacgctggcgattaaaggaatacgcggcaacggcatcaaacgcaagctgatgcttccgtttactctgtacaaaaccgtccgcgaagcgcagcggattatccgcaaacaccgtgtcgagtgcgtcatcggcttcggcggttttgttacctttcccggcggtctggcggcgaaactcttgggcgtgccgattgtgattcacgagcaaaacgccgtggcaggcttgtccaaccgccacctgtcgcgctgggcgaaacgggtgttgtacgcttttccgaaagcgttcagccacgaaggcggtttggtcggcaaccccgtccgcgccgatattagcaacctgcccgtgcctgccgaacgcttccaagggcgcgaaggccgtctgaaaattttggtggtcggcggcagtttgggtgcggacgttttgaacaaaaccgtaccgcaggcgttggcactgctgcctgaagaggtgcgcccgcagatgtaccaccagtcggggcgtaacaagctgggcaatcttcaggcggattatgacgcgttgggcgtgaaagcggaatgcgtggaatttattaccgacatggtgtccgcctaccgtgatgccgatttggtgatttgccgtgccggcgcgctgacgattgccgagttgacggcggcggggctgggcgcgttgttagtgccgtatcctcacgccgttgatgaccatcaaaccgccaacgcgcgtttcatggtgcaggcagaagcggggctgctgttgccgcaaacccagttgacggcggaaaaactcgccgaaatcctcggcagcctcaaccgcgaaaaatgcctcaaatgggcggaaaacgcccgtacgttggcattgccgcacagcgcggatgacgttgccgaagccgcgattgcgtgtgcggcg

SEQ ID NO: 7628 - protein, 355 aa, Neisseria gonorrhoeae
MGGKTFMLMAGGTGGHIFPALAVADSLRVRGHHVIWLGSKDSMEERIVPQYGIRLETLAIKGIRGNGIKRKLMLPFTLYKTVREAQRIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPEEVRPQMYHQSGRNKLGNLQADYDALGVKAECVEFITDMVSAYRDADLVICRAGALTIAELTAAGLGALLVPYPHAVDDHQTANARFMVQAEAGLLLPQTQLTAEKLAEILGSLNREKCLKWAENARTLALPHSADDVAEAAIACAA

SEQ ID NO: 7629 - DNA, 150 bp, Neisseria gonorrhoeae
ggacctgagaaacctttttacccgataagtttccgcaccgacagacccggattcccgcctgagcgggaatgacggcggagcggtttctgttttttccgataaattcctaaaactcaaaatttcatcattcctacaaaaacagaaaaccaa

SEQ ID NO: 7630 - protein, 23 aa, Neisseria gonorrhoeae
GPEKPFYPISFRTDRPGFPPERE

SEQ ID NO: 7631 - DNA, 165 bp, Neisseria gonorrhoeae
ttgctgttgtcccacgtcctagattcccgcctgcgcgggaatgacgcgtttcatttgccgccccctcccgaaaaacgcaaaaaaatgccgtccgaagacctttcggacggcatttgcggaaaaaccggccgcgcgggcgggtcagaagaagacttcgcgccagct

SEQ ID NO: 7632 - protein, 55 aa, Neisseria gonorrhoeae
LLLSHVLDSRLRGNDAFHLPPPPEKRKKMPSEDLSDGICGKTGRAGGSEEDFAPA

SEQ ID NO: 7633 - DNA, 462 bp, Neisseria gonorrhoeae; identical to SEQ ID NO: 157

SEQ ID NO: 7634 - protein, 154 aa, Neisseria gonorrhoeae; identical to SEQ ID NO: 158

SEQ ID NO: 7635 - DNA, 1386 bp, Neisseria gonorrhoeae
ttgggatgtatcgtatgttcggacggcattgtctgccgtctgaaatttttgccctttgcggcaggtgcaaacagactggcaggtggttttttgaagatttcggaagtattggtaaaagtgggcgacggtgtccacactctgctgctcgacaggccgattgtgcgcgacggcaggaaattcgacgcgccgcttttgtggatggtggtgctgatgacggcgttcggcctgctgatgatttattcggcttctgtgtatttggcatcgaaggaaggcggcgatcagtttttctatttgaccaggcaggcggggttcgtcgttgccggccttatagcgagcggttttttatggtttctttgcaggatgaggacatggcggcggcttgtgccgtggatttttgccttatccggcctgttgctggtagccgtattgattgccgggcgcgaaatcaatggcgcgacccgttggatacctttgggtccgttgaatttccagccgaccgagctgttcaagctggcagtcatcctttatttggcaagcctgttcacgcgccgtgaagaagtgttgcgcagcatggaaagtttgggttggcagtcgatttggcgggggacggccaacctgattatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattaccgttggaatgctgtttctggcaggattgccgtggaaatatttttttgtcctggtaggcagcgtcttgggtgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgctgaagaattcggcttcttcgggatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatcgattatgaaaaccgccagaaaatgcgcggttaccgggtggag

SEQ ID NO: 7636 - protein, 462 aa, Neisseria gonorrhoeae
LGCIVCSDGIVCRLKFLPFAAGANRLAGGFLKISEVLVKVGDGVHTLLLDRPIVRDGRKFDAPLLWMVVLMTAFGLLMIYSASVYLASKEGGDQFFYLTRQAGFVVAGLIASGFLWFLCRMRTWRRLVPWIFALSGLLLVAVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVITVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRQKMRGYRVE

SEQ ID NO: 7637 - DNA, 291 bp, Neisseria gonorrhoeae; identical to SEQ ID NO: 6533

SEQ ID NO: 7638 - protein, 97 aa, Neisseria gonorrhoeae; identical to SEQ ID NO: 6534

SEQ ID NO: 7639 - DNA, 276 bp, Neisseria gonorrhoeae
ttgcaacccttgttgaccgaaggtaaattgggttttatagacaacttcagggcagcctctgctgggggcgaagtagttgttgtggcatgtgacattttcgtagctgtagcctaccaaccccgggcgggtcgtactaatccaatcaacggcattgccgcgccctttcagactatcggtatcaaaaccggaaaccttgccgtagggcggcaggtaggtcgccgccccgaaaacgacgataccgcctttttgagcaacaacgttatcggtattatcgaa

SEQ ID NO: 7640 - protein, 92 aa, Neisseria gonorrhoeae
LQPLLTEGKLGFIDNFRAASAGGEVVVVACDIFVAVAYQPRAGRTNPINGIAAPFQTIGIKTGNLAVGRQVGRRPENDDTAFLSNNVIGIIE

SEQ ID NO: 7641 - DNA, 303 bp, Neisseria gonorrhoeae; identical to SEQ ID NO: 6571

SEQ ID NO: 7642 - protein, 101 aa, Neisseria gonorrhoeae; identical to SEQ ID NO: 6572

SEQ ID NO: 7643 - DNA, 2622 bp, Neisseria gonorrhoeae
gaagaagacttcgcgccagcttaagcgtttgataccgcacatcgggccggtaatatccaagctgtccaaatcgttcatcagcagggtgcgcacaccttttccggagaagcaccggttattgcgggcgggttttttaccctctttgaatgttccgctgccgcctgcatcaccgtctgccgtgacggggaaatcgtctgttttcttttcgtccaggtaacgcacattaaccggtttgtcgtaaacatatccgttcgggcagacggttttgccgtttttccacatgcagcctatggggatggacttgccgttcattttctgatggccggaatattgcgcaacctggttatccggcacaatcgggcgcgcgcttctcggagtcaatgcgccgccgtcggcggtattgatgcccaaaatggcggtttgtgcgccgcatttgtcattacccgtatagctgcggatggtgacaaaggcggtacgcaataccacggtcggtttgacggtaacgcgttgtccttccttcagcttcactacccaccccttactgcccgatccgtcggatcccttgttcaggaataatgttttattttcctctttaagcacttgctcgagcaacccgcctcccgtgccgttttgtaccgttaccttaaccgtccccttatcgtcgtcaaagataccgtaaatatattgttcgcccgtattcagtacatcatcttcggtcaaatcgctgcccgtaccgaagatgacgacgcgtttgtctgccagtcgggaaacggcgggcgcggaagtaatcggcttgtcgccttcgaaaatagtccttacagaccatttatcaggattggaatcgctcaaatcaaagcggtacatattgccgccccggtcgccggcataggcgatatcgaccgtgccgtccaaatctttatccaccagcgtgggggacgaaagcccgcccttgccgccctgcacttcgatttttttaatcagactaccactgccgttttccaaatcatatacatacagcgcggttttattatcgccgctgccaatatttttagccgcataaccggaagcgaggaaggcggcgtatttgccgttttgggttttgccgatttgcggcgtgccgacggtgtagcctaattccactttcacgcgatttttgccgttattatcgccatttttgacatcaaacaggggagcggcggctggataatttccgtcgattttgcttaaatccaaggcatacgcgcctctgccgccaaaacccatcgcaccaaacataaagaaatgtttttgcttgtcttggtcatctgtaatgcggcgcaagacaaagccgccgtccacgccgtagcggtcgcccacatagcctttttcggcaaaggcgcgcagctctttggcgagtgtagaatcgttgctttcaatatccttgcgcggcatcgtgccggggatgtagctgagcttcagattgtagctgcgttcatcactgccgccgttttttttgaagatatgcaccatcccgtcgttcgcggcggttgccaaatacccgccgaccgcgacaatcgggctgttgacgatgtcgcccaaatcgcgattgccgttttcgcggatgcggtatctttggctgtatttgtctgattctcggttaattgatttaaatcgaccgtcatcggcagcagcacgaaccgtccaaggcagcagcacttttttccactcgtcggctttaagattgacgttcgcttccttaacaatgccgaaagtgccgttgttgccggtgtttccaaaagtgacgacctcatccttgtttctattcagtttgatcagctgtacgccgctatccaatcggatgattgtttcccgccccatgaaactcggctctttacttttaatatcattctcattcaaggttacgagggaatagcggccgggtttgccggattcagtttttcttttcagattttgaaggtagatgcggctgctcgaactgtcggggtaggtagaaaccgaagcggaatacatctgcaccttgccattttgcacagggccgaaccacagcgcgggggcggtcagtgccggcgaaggggctttggtattattattggggttcggtttgttgatgcagcggcctgctttgacttgcggcaggcctagattgacgctgacttttcctttatcttcaagcgtccaattacctagaaaaaatctatccagcctgtttttccatcctttcgacagttcgatgcgcggtttcaaggtacccaaatcaactgttttgccttgcgtgatatctttgatttgggttttatccagcaggtgcagtttggcgttcagataaaaggcgatggcggagtgttcgttctgcccgacataacgggaagaatatttattaccgtcgcctgtcgtataaacgaggttttggtctttgtattgggggttcccactattttgctgcgtcacatcctcgttaaaataaaatatctttttattgtgtcttttttctttgactaagctctcgctgctcaaattgaaagacacgcccaaccaaggataatccgacaatttataaatgggcgaattgtcgcggcttttgtcttcgtatatatccagcttgttgcctgcctttctttgcaa

SEQ ID NO: 7644 - protein, 7 aa, Neisseria gonorrhoeae
EEDFAPA

SEQ ID NO: 7645 - DNA, 1335 bp, Neisseria gonorrhoeae
atgactttccaaaacaaaaaaatcctcgtcgccggacttggcggcacgggtatttccatgattgcctatctgcgcaaaaacggcgcggaggttgccgcttatgatgcggagctgaaagccgagcgcgtggcgcaaatcggtaagatgtttgacgggctggtgttttacacgggtcgtctgaaagatgcgttggacaacggtttcgatattctggcgctcagtcccggcatcagcgagcggcagccggatatcgaggcgttcaagcaaaacggcgggcgcgtgctaggcgacatcgaattgctggcggacattgtgaaccgccgcggcgacaaggtgattgcgattaccggcagcaacggcaaaaccacggtaacgagcctggtcggctatctctgcatcaagtgcgggctggataccgtcattgcgggcaatatcggtacgccggttttggaggcagaattgcagcgcgaaggcaaaaaggcggacgtgtgggtgttggagctttccagcttccaactggaaaacaccgaaagcctgcgcccgactgcggcgacggtgatgaacatttccgaagaccatctcgaccgctacgacgatttgctcgactacgcgcataccaaagccgagattttccgtggcgatggagtgcaggttttgaatgcggacgacgtgttctgccgcgccatgaaacgggcagggcgtgaagtgaaacggttttccttggaacacgaagccgatttttggttggaacgcgggacgggctgtttaaaacaaggcaatgaagatttgatttctacgcaagacatcccgctgcaaggtttgcacaacgccgccaacgttatggctgccgtggctttgtgcgaggccgtcggtttgccgcgcgaagcattgctggaacacgtcaaaaccttccaaggcttgccgcaccgtgtggaaaaaatcggcgagaaaaacggcgtggtattcatcgacgacagcaaaggcacgaatgtcggcgcgaccgccgccgcgattgccggtttgcaaaacccgctcttcgtgattttgggcggcatgggcaaagggcaggacttcacgcccctgcgcgacgcgttgaaagataaggcaaaaggcgtgttcctgatcggcgtcgatgcgccgcaaatccgccgcgatttggacggctgcggcttgaacctgaccgactgcgtcactttggaagaggcggttcagacggcatacgcccaagccgaagcgggcgatattgtcttgctcagccccgcctgcgcgagtttcgatatgtttaaaggctacgcgcaccgttcggaagtgtttatcgaagcgtttaaggctttg

SEQ ID NO: 7646 - protein, 445 aa, Neisseria gonorrhoeae
MTFQNKKILVAGLGGTGISMIAYLRKNGAEVAAYDAELKAERVAQIGKMFDGLVFYTGRLKDALDNGFDILALSPGISERQPDIEAFKQNGGRVLGDIELLADIVNRRGDKVIAITGSNGKTTVTSLVGYLCIKCGLDTVIAGNIGTPVLEAELQREGKKADVWVLELSSFQLENTESLRPTAATVMNISEDHLDRYDDLLDYAHTKAEIFRGDGVQVLNADDVFCRAMKRAGREVKRFSLEHEADFWLERGTGCLKQGNEDLISTQDIPLQGLHNAANVMAAVALCEAVGLPREALLEHVKTFQGLPHRVEKIGEKNGVVFIDDSKGTNVGATAAAIAGLQNPLFVILGGMGKGQDFTPLRDALKDKAKGVFLIGVDAPQIRRDLDGCGLNLTDCVTLEEAVQTAYAQAEAGDIVLLSPACASFDMFKGYAHRSEVFIEAFKAL

SEQ ID NO: 7647 - DNA, 165 bp, Neisseria gonorrhoeae
ttgtttttgtgcggtatccatcgggtttgggattcggataaatgttcagactgcattgtatcgcagattttgcagggaaacggcaaacgcccggggcgcgcggcgttgtttggggagttgttcgggggggggggttggatgcagttgctacgaatcgctatcctg

SEQ ID NO: 7648 - protein, 55 aa, Neisseria gonorrhoeae
LFLCGIHRVWDSDKCSDCIVSQILQGNGKRPGRAALFGELFGGGGWMQLLRIAIL

SEQ ID NO: 7649 - DNA, 294 bp, Neisseria gonorrhoeae
gtgtttcttctgattttaaaattatttgtatgggtaaattggcgctccctgtctttttttggcgctgatgaatatgactgcccccactttacctcgggcagattttgcgcgttcatcacaatagcgtatttatacgtttgcgccatcgcccccccccccgccggtatgggaaaacatcaatatggcggcataaagcgcggtatggcggaaaacctgccttttcaaagttttattcatattttattccttaagtttgccttcgcgggacggcgcgccgcgaacgccggggttcgg

SEQ ID NO: 7650 - protein, 98 aa, Neisseria gonorrhoeae
VFLLILKLFVWVNWRSLSFFGADEYDCPHFTSGRFCAFITIAYLYVCAIAPPPAGMGKHQYGGIKRGMAENLPFQSFIHILFLKFAFAGRRAANAGVR

SEQ ID NO: 7651 - DNA, 261 bp, Neisseria gonorrhoeae
ttggaaagtcattttggttttgtcctaaaacaaatcatattgggcaggagacgtccgcccttgcccaagccgctttcagacggcatcgcgagccgattaataacccgccttcaggcgttggtcattgtcgcagctgttttggtctccgttttgacaagccttgccaagccattgttgagcgagcgcaaggtcttggcgcacgccgcgtccatcgtaatacatcaagcccaaattgtattgggcttgggcatccccttgttc

SEQ ID NO: 7652 - protein, 87 aa, Neisseria gonorrhoeae
LESHFGFVLKQIILGRRRPPLPKPLSDGIASRLITRLQALVIVAAVLVSVLTSLAKPLLSERKVLAHAASIVIHQAQIVLGLGIPLF

SEQ ID NO: 7653 - DNA, 795 bp, Neisseria gonorrhoeae; identical to SEQ ID NO: 6589

SEQ ID NO: 7654 - protein, 265 aa, Neisseria gonorrhoeae; identical to SEQ ID NO: 6590

SEQ ID NO: 7655 - DNA, 390 bp, Neisseria gonorrhoeae
atgcagaaaaaaagacattcgcgccgacaccttttcatccccacaagttccaaacacatttccggcttaaatatccacagcattcccgttcttaaaggcaccggcagccattcggtaaagaaaagcgggatgtcgtccgcacaacaagcaaactatccacaaaacctattccccacgaaaaacaatccacaggtatgcacaaaagggaatcctccttaccgacacccttttaaaacggcaattcagatgattttaaaaataaaaaaaagttacccacagaaaattccccatatcaatataatcatcgttttattatttaaaccttatattttatttataacccttcagggaaacggcacggcaaagcgtaaaggcatcttttcaaaaaat

SEQ ID NO: 7656 - protein, 130 aa, Neisseria gonorrhoeae
MQKKRHSRRHLFIPTSSKHISGLNIHSIPVLKGTGSHSVKKSGMSSAQQANYPQNLFPTKNNPQVCTKGNPPYRHPFKTAIQMILKIKKSYPQKIPHINIIIVLLFKPYILFITLQGNGTAKRKGIFSKN

SEQ ID NO: 7657 - DNA, 120 bp, Neisseria gonorrhoeae
ttgcatttttacaacacttactcgggagggtattggagggcattgcaaaccgggggttatagcggattaacaaaaaccggtacggcgttgccccgccccgacccaaagggaacggttccc

SEQ ID NO: 7658 - protein, 40 aa, Neisseria gonorrhoeae
LHFYNTYSGGYWRALQTGGYSGLTKTGTALPRPDPKGTVP

SEQ ID NO: 7659 - DNA, 1446 bp, Neisseria gonorrhoeae
atgaaaggcgatattggcgtaatcggtttggcggttatggggcaaaacctgattttgaatatgaacgattgcggatttaaggttgtcgcctacaaccggacaatcggtaaagtggacgaatttttaaacggtgcggcaaaagagacgggcattatcggcgcgtattccctgcaagacttggtcgataagctggcaaaaccgagaaaaatcatgatgatggttcgcgcaggttcggtggttgacgactttgtcgaacaactgcttccgctgttggaagaaggcgacatcattatcgacggcggcaatgccaattaccccgacacgacacggcggacacattaccttgccggaaaagggattttgtttgtcggcgcgggcgtatccggcggcgaagaaggcgcgcggcgcgggccgtccatcatgccgggcggggataagcgcgcttgggaagcggtcaagccgattttccaggcgattgccgccaaaacgccgcagggcgaaccgtgttgcgactgggtcggcaaggatggcgcgggacattttgtcaaaatggtgcacaacggcatcgaatacggcgatatgcagctgatttgcgaagcgtaccagtttatgaaagacggtttggggctgtcctacgacgaaatgcaccgcgtgtttgccgagtggaataaaaccgagctggattcttatctgattgaaatcacagcggcaattttgggctataaggacgaaggcggcgaaccgctggccgagaaaatcctcgatacggcagggcaaaaaggcacgggcaaatggacgggcatcaatgccttggatttgggcattccgctgacgctgatttccgaagccgtattcgcccgctgtgtttcgtcgttcaaagaacagcgcgtgcagaccggcaagctgttcgcccgaaccgccacgcccgtcgaaggcggcaaacaagaatgggtcgaggcgttgaggcaggctttgcttgcctccaaaatcatttcctacgcacaaggctttatgttgatccgcgaagcgggcgaaagttacggctggggtttggactacggcaacactgcgctgctgtggcgcgaaggctgcatcatccgcagcgcgtttttgggcaatatccgcgacgcgtatgaggccaatcccgatttggtgttcttgggtgcggatccgtatttcaaaaatattttggaaaactgcctgccggcatggcgcaaggtggttgccaaggcggtcgaatgcggcatccctatgccctgcatggcttcggcgattacgttcttggacggctatacgaccgaacgcctgcctgccaacctcttgcaggcacagcgcgactacttcggcgcgcacacttacgagcgcaccgacaaaccgcgcggcgaatttttccataccaactggacgggcaagggcggagataccgcttcgacaacctacgatatt

SEQ ID NO: 7660 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 7661 - DNA, 1044 bp, Neisseria gonorrhoeae; identical to SEQ ID NO: 6601

SEQ ID NO: 7662 - protein, 348 aa, Neisseria gonorrhoeae; identical to SEQ ID NO: 6602

SEQ ID NO: 7663 - DNA, 1476 bp, Neisseria gonorrhoeae
aacggtgcggcaaaagagacgggcattatcggcgcgtattccctgcaagacttggtcgataagctggcaaaaccgagaaaaatcatgatgatggttcgcgcaggttcggtggttgacgactttgtcgaacaactgcttccgctgttggaagaaggcgacatcattatcgacggcggcaatgccaattaccccgacacgacacggcggacacattaccttgccggaaaagggattttgtttgtcggcgcgggcgtatccggcggcgaagaaggcgcgcggcgcgggccgtccatcatgccgggcggggataagcgcgcttgggaagcggtcaagccgattttccaggcgattgccgccaaaacgccgcagggcgaaccgtgttgcgactgggtcggcaaggatggcgcgggacattttgtcaaaatggtgcacaacggcatcgaatacggcgatatgcagctgatttgcgaagcgtaccagtttatgaaagacggtttggggctgtcctacgacgaaatgcaccgcgtgtttgccgagtggaataaaaccgagctggattcttatctgattgaaatcacagcggcaattttgggctataaggacgaaggcggcgaaccgctggccgagaaaatcctcgatacggcagggcaaaaaggcacgggcaaatggacgggcatcaatgccttggatttgggcattccgctgacgctgatttccgaagccgtattcgcccgctgtgtttcgtcgttcaaagaacagcgcgtgcagaccggcaagctgttcgcccgaaccgccacgcccgtcgaaggcggcaaacaagaatgggtcgaggcgttgaggcaggctttgcttgcctccaaaatcatttcctacgcacaaggctttatgttgatccgcgaagcgggcgaaagttacggctggggtttggactacggcaacactgcgctgctgtggcgcgaaggctgcatcatccgcagcgcgtttttgggcaatatccgcgacgcgtatgaggccaatcccgatttggtgttcttgggtgcggatccgtatttcaaaaatattttggaaaactgcctgccggcatggcgcaaggtggttgccaaggcggtcgaatgcggcatccctatgccctgcatggcttcggcgattacgttcttggacggctatacgaccgaacgcctgcctgccaacctcttgcaggcacagcgcgactacttcggcgcgcacacttacgagcgcaccgacaaaccgcgcggcgaatttttccataccaactggacgggcaagggcggagataccgcttcgacaacctacgatatttgattccgttgccgaaatgccgtccgaaccgttcggacggcatttgttttgcaggaaatagaaagatgttccaatggctttatgatgtattgtggctgcttgcgccgatatggatacggcgttatttggacaaacgctccggaagtgccccggcat

SEQ ID NO: 7664 - protein, 440 aa, Neisseria gonorrhoeae
NGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 7665 - DNA, 1080 bp, Neisseria gonorrhoeae
atgtttttatggctcgcacatttcagcaactggttaaccggtctgaatatttttcaatacaccacattccgcgccgttatggcggcgttgaccgccttggcgttttccctgatgttcggcccgtggacgatacgcaggctgaccgcgctcaaatgcgggcaggcagtgcgtaccgacggcccgcaaacccacctcgtcaaaaacggcacgccgacgatgggcggttcgctgattctgaccgccattaccgtgtccaccctgttgtggggcaactgggcgaacccgtatatctggattctcttgggcgtactgcttgccaccggtgcgctcggtttttacgacgactggcgcaaagtcgtttataaagaccccaacggcgtgtccgccaaattcaaaatggtgtggcagtcaagcgttgccgttatcgccggtttggcattgttttaccttgccgccaattccgccaacaatattttgattgtcccgtttttcaaacaaatcgccctgccgctgggcgtggtcggctttttggtgttgtcttacctgaccatcgtcggcacatccaacgccgtcaacctcaccgacggcttggacggccttgccgccttccccgtcgtcctcgttgccgccgggctcgccattttcgcctacgtcagcggacactaccaattttcccaatacctccagcttccctatgtcgccggcgcgaacgaagtcgctatattctgcaccgccatgtgcggcgcgtgcctcggatttttgtggttcaacgcctatcccgcgcaagtctttatgggcgatgtcggcgcgctggcattgggtgccgcgctcggtaccgttgccgtcatcgtccgccaagaatttgtcctcgtcattatgggcggtctgttcgtcgtagaagccgtgtccgttatgcttcaggtcggctggtacaagaaaaccaaaaaacgcatcttcctgatggcgccgattcatcaccattacgaacaaaaaggctggaaagaaacccaagtcgtcgtccgtttctggattattaccatcgtcttggtattgatcggtttgagtaccctcaaaattcgc

SEQ ID NO: 7666 - protein, 360 aa, Neisseria gonorrhoeae
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLAAFPVVLVAAGLAIFAYVSGHYQFSQYLQLPYVAGANEVAIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIR

SEQ ID NO: 7667 - DNA, 1335 bp, Neisseria gonorrhoeae
ttgattccgttgccgaaatgccgtccgaaccgttcggacggcatttgttttgcaggaaatagaaagatgttccaatggctttatgatgtattgtggctgcttgcgccgatatggatacggcgttatttggacaaacgctccggaagtgccccggcataccgggcgcatagggacgagcgtttcggcaagccgcatccgaatcccgttaccggcgcggtttggatacacgccgtttcggtcggagaaacgcgtgccgcccagcccttgatacgcgagttgcggcggcgttttcccgatgcgccgctgctgatgacgcagatgaccccgacgggacgggaaaccgcgcaagttctgtttcccgatgcgcaatgccgctatcttccgtatgacaaaaaaacgtgggtacggcagtttttgcgcgaacaccgcccgatgttcggcattttgatggaaaccgaaatctggcccaatctgatgaaggaatgccggcgagcgggtgtgccgctgtttttggcgaatgcgcggctgtcggaaaaatcgctgaacggttatctgaaagtccgccgcctgatccgtcccgcagccgcttcgctgacgggctgtctggcgcagacggaggcggatgcggcgcggttggcgaaattgggcgcggcatccgtgcaggtgtgcggcaataccaaatacgacctgatgccgtctgaagacatgaaaacgctggcggggcagtttgaaaaacgcatcggaggccggccggttgccgtgtgcggcagcacgcgcgtttatcggggcgaagacgaggcggaaaaactgctggcggcgtggcaacaatatcgcggcgatgccctgctggccgtcgtgccgcgccatcccgagcattttcagacgacatttgaaacggcgaaacgcttcgggtttaaggttcagcggcgcagcgacggtttgccggtcgaacccgatacgcaggtgtgggtaggcgacagtatgggcgagctgtatgcgtattacctgtgcgccgatgtcgcttttgtcggcggcagtctggtcggttcgggctgtcagaacatcatcgaaccgctttcctgcggcgttacgacgatattcggcttttcgacctacaatttttccgaagcctgccggcacgccttggcatcgggtgcggcggttcaagtcgaatcggcggacgcgtggcgtgaagccgttgaaaaaaccttatctggcgaggggggcggaatgcagatgcaggcgcgcgtggacggctttatcgcacaacatcgcggagcgggcgcgagaatcgccgaggcggtgcgggaagcggtatgcggacatcgggggcga

SEQ ID NO: 7668 - protein, 445 aa, Neisseria gonorrhoeae
LIPLPKCRPNRSDGICFAGNRKMFQWLYDVLWLLAPIWIRRYLDKRSGSAPAYRAHRDERFGKPHPNPVTGAVWIHAVSVGETRAAQPLIRELRRRFPDAPLLMTQMTPTGRETAQVLFPDAQCRYLPYDKKTWVRQFLREHRPMFGILMETEIWPNLMKECRRAGVPLFLANARLSEKSLNGYLKVRRLIRPAAASLTGCLAQTEADAARLAKLGAASVQVCGNTKYDLMPSEDMKTLAGQFEKRIGGRPVAVCGSTRVYRGEDEAEKLLAAWQQYRGDALLAVVPRHPEHFQTTFETAKRFGFKVQRRSDGLPVEPDTQVWVGDSMGELYAYYLCADVAFVGGSLVGSGCQNIIEPLSCGVTTIFGFSTYNFSEACRHALASGAAVQVESADAWREAVEKTLSGEGGGMQMQARVDGFIAQHRGAGARIAEAVREAVCGHRGR

SEQ ID NO: 7669 - DNA, 90 bp, Neisseria gonorrhoeae
ttgggaaagtccctgcacgttaatctgcaaaagccgtccgaaaccttgccggacagcaagcaaacctcaagcgggcgcaagcccgatgta

SEQ ID NO: 7670 - protein, 30 aa, Neisseria gonorrhoeae
LGKSLHVNLQKPSETLPDSKQTSSGRKPDV

SEQ ID NO: 7671 - DNA, 918 bp, Neisseria gonorrhoeae
atgaccttaaccgaattgcggtacatcgtcgcagtcgcccaagaacgtcatttcggccgggcggcgcggcgttgttttgtcagccagcccactttgtctattgccattaagaaattggaagaagagcttgccgtctctttgtttgaccggagcagcaacgatattattacgaccgaggcgggggaacgtatcgttgcacaggcgcgtaaggtattgaaagaggcggagcttatcaggcatttggcaaatgaagaacaaaacgagctggagggtgcgttcaaactcgggctgatttttacggttgcgccatacctgctgccgaaactgattgtctcgttgcgccgtactgcaccgaaaatgcctttgatgttggaagagaattacacgcatactttgaccgagtcgctcaaacgcggggacgttgacgcgattatcgttgccgaaccgtttcaagagccgggcattgttaccgaacccttgtatgacgaaccgtttttcgtgattgtcccgaaagggcattcatttgaggaactggatgccgtttcgccccggatgctgggtgaggagcaggttttgctgctgacggaaggcaactgtatgcgggatcaggtactctcaagctgttccgaattggcggcgaaacagcgcatacaggggctgaccaatacattgcagggcagctcgatcaatacaatccgccatatggtcgccagcggtttggcaatcagcgtgttgccggcaaccgcgctgaccgagaacgatcatatgctgttcagcattattccgtttgaaggtacgccgccaagccggcgggtcgtattggcgtatcgccgtaattttgtccgtccgaaggcgttgtcggcgatgaaggcggcgattatgcagtcgcagcttcacggggtaagttttatccacgac

SEQ ID NO: 7672 - protein, 306 aa, Neisseria gonorrhoeae
MTLTELRYIVAVAQERHFGRAARRCFVSQPTLSIAIKKLEEELAVSLFDRSSNDIITTEAGERIVAQARKVLKEAELIRHLANEEQNELEGAFKLGLIFTVAPYLLPKLIVSLRRTAPKMPLMLEENYTHTLTESLKRGDVDAIIVAEPFQEPGIVTEPLYDEPFFVIVPKGHSFEELDAVSPRMLGEEQVLLLTEGNCMRDQVLSSCSELAAKQRIQGLTNTLQGSSINTIRHMVASGLAISVLPATALTENDHMLFSIIPFEGTPPSRRVVLAYRRNFVRPKALSAMKAAIMQSQLHGVSFIHD

SEQ ID NO: 7673 - DNA, 459 bp, Neisseria gonorrhoeae
ttggagcatcgtatgagtatttatgccgtcgcgcacatcatccacctgtattgcgccaccgcctttgtcggcggcgtgttttttgaagtgctggttttgtccgtcctgcatacgggacgggtgtcgcgcgaggcgcggcgcgaagtggaaaaggcaatgtcttaccgcgccgtcagggtgatgccgtttgcggtcggactgctgttcgccagcggcatcgtgatggcggcaaaccgctaccttcctatatcgggcgaaccgtttgccacttccttcggcacaatgctgacgctgaaaatcctgttggcgttcagcgtgttggcgcacttcgccatcgccgtcgtcaaaatggcgcgttccacgctgacggtcggctggtcgaaatacatacacgccgtcgtctttacccatatgctgctgattgtctttttggcaaaagcgatgttttatatcagctgg

SEQ ID NO: 7674 - protein, 153 aa, Neisseria gonorrhoeae
LEHRMSIYAVAHIIHLYCATAFVGGVFFEVLVLSVLHTGRVSREARREVEKAMSYRAVRVMPFAVGLLFASGIVMAANRYLPISGEPFATSFGTMLTLKILLAFSVLAHFAIAVVKMARSTLTVGWSKYIHAVVFTHMLLIVFLAKAMFYISW

SEQ ID NO: 7675 - DNA, 180 bp, Neisseria gonorrhoeae
gtgaaaatgaaaagccgacgtttttttaaagccttattgctgattgccgcgctggtcggcgcgttttatgccggaatgcggacgcaggcgtatctttatgaagatttatgtttagacttgggcggcggcaaaaatccggggagctacccgatttgcgtgattgggaaagtccctgcacgt

SEQ ID NO: 7676 - protein, 60 aa, Neisseria gonorrhoeae
VKMKSRRFFKALLLIAALVGAFYAGMRTQAYLYEDLCLDLGGGKNPGSYPICVIGKVPAR

SEQ ID NO: 7677 - DNA, 261 bp, Neisseria gonorrhoeae
atgtcattgatcgaacttttattcggtagaaagcagaaaacggcaaccgttgcccgcgaccgccttcaaatcatcattgcccaagagcgcgcccaagaaggtcagactccggattacctgccgactttacgtaaagagttgatggaagtcctgtccaaatatgtgaatgtttcattagacaatatccgtatttcccaagaaaagcaggatggtatggatgtgcttgagttgaacattactttgccggaacagaaaaaggta

SEQ ID NO: 7678 - protein, 87 aa, Neisseria gonorrhoeae
MSLIELLFGRKQKTATVARDRLQIIIAQERAQEGQTPDYLPTLRKELMEVLSKYVNVSLDNIRISQEKQDGMDVLELNITLPEQKKV

SEQ ID NO: 7679 - DNA, 1230 bp, Neisseria gonorrhoeae; identical to SEQ ID NO: 4093

SEQ ID NO: 7680 - protein, 410 aa, Neisseria gonorrhoeae; identical to SEQ ID NO: 4094

SEQ ID NO: 7681 - DNA, 1503 bp, Neisseria gonorrhoeae
atgccgtctgaacgacagaatgcggttttcagacggcatttccccatcccgatattgctcaaacaaaaccgaagcgtttgctataattgcactttttaccgcacacgcacgcccatgtttcccgatttctcccaaaccctctccaaagaccgccacttcctgcaatccgccttcaaaaatcccaacaaatacggcggcttgtccaaaatcgaagaaaaataccgaaaatcgcacgaaatcttcttgaaacgtttggccgcattgccaaaacccgaattcgacgacaccctgcccgttcacgaaaaactcgaagaaatcaaaaaaaccgttgccgaaaatcaggtaacgattatctgcggcgaaaccggttcgggcaaaaccacgcagttgcccaagatttgtttggaactcgggcgtggggcggcaggattgatcgggcatacccagccgcgccgtttggccgcgcgttcggtggcggagcggattgccgaagagctgaaatccgaaatcggcagcgcggtcggctataaagtgcgctttaccgaccacacctcgcgcgatgcctgcgtcaagctgatgaccgacggcatcctgctggcggaaacccagaccgaccgttatctcgccgcctacgacacgattatcattgacgaagcgcatgaacgcagcctgaacatcgacttcctcttgggctacctaaaacaactcctgccgcgccgccccgatttgaaagtcatcatcacatcagccaccatagacgcagaacgcttctcccgacacttcaacggcgcgcccgtactggaagtgagcgggcgcacctatcccgtcgaaatcctctaccgaccgctgaccggcaaagacgaagacgacgcagaagtcgagctgaccgacgcgattgtcgatgccgccgacgaattggcacgctacggcgaaggcgatattttagtattcctgccgggcgaacgcgaaatccgcgaagcggcagaagccctgcgcaaatccacactgcgccgcaatgacgaaatcctgcccctgtttgcacgcctgtcgcacgccgaacagcacaaaatcttccacccttcaggcgcaaaatgccgcatcgtgctggcgaccaacgtcgccgaaacctcgctcaccgtgccgggcatcaaatacgtcatcgacaccggcctcgcgcgcgtcaaacgctattccgcgcgggcaaaagtggaacaacttcacgtagaaaaaatctcccaagccgccgcccgccaacgctccggccgctgcggacgcgtctcagcaggcgtgtgtatccgactgttttcagaagaagattttaacagccgtcccgaatttaccgatcccgaaatcgtccgcagcaacctcgccgccgtcatcctgcgcatggcatcgctgaacttgggcgacgtagcagcattcccgtttttagaaatgcccgattcgcgatatatcaatgacggttttcaggtgttgctggaattgggggcagtggaggttgtc

SEQ ID NO: 7682 - protein, 501 aa, Neisseria gonorrhoeae
MPSERQNAVFRRHFPIPILLKQNRSVCYNCTFYRTRTPMFPDFSQTLSKDRHFLQSAFKNPNKYGGLSKIEEKYRKSHEIFLKRLAALPKPEFDDTLPVHEKLEEIKKTVAENQVTIICGETGSGKTTQLPKICLELGRGAAGLIGHTQPRRLAARSVAERIAEELKSEIGSAVGYKVRFTDHTSRDACVKLMTDGILLAETQTDRYLAAYDTIIIDEAHERSLNIDFLLGYLKQLLPRRPDLKVIITSATIDAERFSRHFNGAPVLEVSGRTYPVEILYRPLTGKDEDDAEVELTDAIVDAADELARYGEGDILVFLPGEREIREAAEALRKSTLRRNDEILPLFARLSHAEQHKIFHPSGAKCRIVLATNVAETSLTVPGIKYVIDTGLARVKRYSARAKVEQLHVEKISQAAARQRSGRCGRVSAGVCIRLFSEEDFNSRPEFTDPEIVRSNLAAVILRMASLNLGDVAAFPFLEMPDSRYINDGFQVLLELGAVEVV

SEQ ID NO: 7683 - DNA, 243 bp, Neisseria gonorrhoeae
ttgatgggaaaatgccgtctgaaaggcttcaggcggcatttttgtttatgggcattgggtaaaatgtctttagaaaagaatattgcaaatttaaaaaatccccgtgttcttatttctgctttcttacgtcattcttttaaaggtgggaatctggaaaccaaaaaacaacaggaatttatccgaaacaacaaaacctatccgccgtcatccccacgaaagcgggaatctagtttgttgttcaaa

SEQ ID NO: 7684 - protein, 81 aa, Neisseria gonorrhoeae
LMGKCRLKGFRRHFCLWALGKMSLEKNIANLKNPRVLISAFLRHSFKGGNLETKKQQEFIRNNKTYPPSSPRKRESSLLFK

SEQ ID NO: 7685 - DNA, 891 bp, Neisseria gonorrhoeae
ggagattgaaccatgacagaatatcccggcatcgggtcgccgttgttttacggcgttttttttgcggcagtgctggtcatgattgccttggatatgttttcgctgaagaaaaacggcagccataaagtcggcatcaaagaaaccttggcatggagcggcttgtgggttgccgtatcctgcctgttcgcaggctggctgtatttcgaactcgccggcaatcccggctacggcgcggcagccgcaaaagaaaaagtattggaattctttaccggctacattttggaaaaatcgttggcagtcgacaatattttcgtgttcctgatgatattcggctacttcaaagtcgcaccgcagtttcagcaccgcgtgctgctgtacggcgtattgggcgcattggtattgcgcaccgtcatgattttcgtcggcgcggcactggttcggcagtttgagtggattctgtatctgtttggcgcgttcctgctctatactggtatacacatgatgaagcccgaaggcgatgagaaagaggatttggcaaacagcaggctgctgaatgccgtcaagaaagtcgttccggtcggcacggaatttcacggcgagaaattttttaccgtcgaaaacggcaaaaaaatcgccacgccgctgtttttggtgctggtcatgattgaattgagcgatgtcgtgtttgctgtggacagtattcccgccgtctttgccgttaccaccgatccgtttatcgtgctgacttccaatattttcgctattttgggtttgcgggcgatgtatttcctgctggcggatgtggcggaacgctttatcttcctgaaatacggcttggcattcgtgttgagttttatcggtgtgaaaatgctggtaatgcattgggtgcat

SEQ ID NO: 7686 - protein, 294 aa, Neisseria gonorrhoeae
TMTEYPGIGSPLFYGVFFAAVLVMIALDMFSLKKNGSHKVGIKETLAWSGLWVAVSCLFAGWLYFELAGNPGYGAAAAKEKVLEFFTGYILEKSLAVDNIFVFLMIFGYFKVAPQFQHRVLLYGVLGALVLRTVMIFVGAALVRQFEWILYLFGAFLLYTGIHMMKPEGDEKEDLANSRLLNAVKKVVPVGTEFHGEKFFTVENGKKIATPLFLVLVMIELSDVVFAVDSIPAVFAVTTDPFIVLTSNIFAILGLRAMYFLLADVAERFIFLKYGLAFVLSFIGVKMLVMHWVH

SEQ ID NO: 7687 - DNA, 138 bp, Neisseria gonorrhoeae
gtgttttaccacagcaaaacaggcgataaaaaaatcagccgctaccgatgtgtccgccgcccgaatattaacgaaagcaaatatgaaaccactggacctaaatttcatctgccaagccctcaagcttccgatgccgtc

SEQ ID NO: 7688 - protein, 46 aa, Neisseria gonorrhoeae
VFYHSKTGDKKISRYRCVRRPNINESKYETTGPKFHLPSPQASDAV

SEQ ID NO: 7689 - DNA, 813 bp, Neisseria gonorrhoeae
gtggcaaaaattattgtagtaacttcaggcaagggcggtgtcggtaaaacgactaccagtgcaagtattgcaacaggtttggcattacgcggatataaaactgcggtaattgattttgatgtgggtttgcgcaacctcgacctcattatgggttgcgagcgtcgtgtcgtttatgacctgatcaatgtcattcagggtgaggcgacgctcaaccaggctttgattaaagataaaaattgtgaaaacctgtttattttgccggcttcccagactcgggataaagacgctttgacacgcgagggcgtagaaaaagtgatgcaggagctgtccggcaagaaaatgggctttgagtatattatttgcgactctcctgctggtattgagcagggtgcattgatggcgttgtattttgctgatgaagccattgtaacgaccaatcctgaggtttccagtgtgcgtgactccgacaggattttgggaattttgcaaagcaaatcccgtaaggcggagcaaggcggttcggttaaagaacatctgttaattacgcgttattctcccgaacgtgtggcaaaaggcgaaatgctgtctgtacaggatatttgcgatattctgcgtattcctttgctgggtgtgattcccgaatcccaaaacgtcttgcaggcatccaattccggagaaccggtcatccatcaggacagcgtaacggcttccgaggcatataaggacgttattgcccgtcttttgggcgagaaccgtgaaatgcgtttcttggaagctgagaaaaaaagcttcttcaaacgtctgttcggagga

SEQ ID NO: 7690 - protein, 271 aa, Neisseria gonorrhoeae
VAKIIVVTSGKGGVGKTTTSASIATGLALRGYKTAVIDFDVGLRNLDLIMGCERRVVYDLINVIQGEATLNQALIKDKNCENLFILPASQTRDKDALTREGVEKVMQELSGKKMGFEYIICDSPAGIEQGALMALYFADEAIVTTNPEVSSVRDSDRILGILQSKSRKAEQGGSVKEHLLITRYSPERVAKGEMLSVQDICDILRIPLLGVIPESQNVLQASNSGEPVIHQDSVTASEAYKDVIARLLGENREMRFLEAEKKSFFKRLFGG

SEQ ID NO: 7691 - DNA, 972 bp, Neisseria gonorrhoeae
atgacagaatatcccggcatcgggtcgccgttgttttacggcgttttttttgcggcagtgctggtcatgattgccttggatatgttttcgctgaagaaaaacggcagccataaagtcggcatcaaagaaaccttggcatggagcggcttgtgggttgccgtatcctgcctgttcgcaggctggctgtatttcgaactcgccggcaatcccggctacggcgcggcagccgcaaaagaaaaagtattggaattctttaccggctacattttggaaaaatcgttggcagtcgacaatattttcgtgttcctgatgatattcggctacttcaaagtcgcaccgcagtttcagcaccgcgtgctgctgtacggcgtattgggcgcattggtattgcgcaccgtcatgattttcgtcggcgcggcactggttcggcagtttgagtggattctgtatctgtttggcgcgttcctgctctatactggtatacacatgatgaagcccgaaggcgatgagaaagaggatttggcaaacagcaggctgctgaatgccgtcaagaaagtcgttccggtcggcacggaatttcacggcgagaaattttttaccgtcgaaaacggcaaaaaaatcgccacgccgctgtttttggtgctggtcatgattgaattgagcgatgtcgtgtttgctgtggacagtattcccgccgtctttgccgttaccaccgatccgtttatcgtgctgacttccaatattttcgctattttgggtttgcgggcgatgtatttcctgctggcggatgtggcggaacgctttatcttcctgaaatacggcttggcattcgtgttgagttttatcggtgtgaaaatgctggtaatgcattgggtgcatatcccgatttccgtttcactgtcggtcgtgttcggcgcgttgggtgcatcgatactgacctcgttaatttatacgaaaaaacagcctgataaa

SEQ ID NO: 7692 - protein, 324 aa, Neisseria gonorrhoeae
MTEYPGIGSPLFYGVFFAAVLVMIALDMFSLKKNGSHKVGIKETLAWSGLWVAVSCLFAGWLYFELAGNPGYGAAAAKEKVLEFFTGYILEKSLAVDNIFVFLMIFGYFKVAPQFQHRVLLYGVLGALVLRTVMIFVGAALVRQFEWILYLFGAFLLYTGIHMMKPEGDEKEDLANSRLLNAVKKVVPVGTEFHGEKFFTVENGKKIATPLFLVLVMIELSDVVFAVDSIPAVFAVTTDPFIVLTSNIFAILGLRAMYFLLADVAERFIFLKYGLAFVLSFIGVKMLVMHWVHIPISVSLSVVFGALGASILTSLIYTKKQPDK

SEQ ID NO: 7693 - DNA, 1308 bp, Neisseria gonorrhoeae
atgccgtctgaaaacaaacccgtgtcgcgcatcgtaaccgacagccgcgatattcgggaaggcgatgtgtttttcgcattggcgggcgggcggtttgacgcgcatgattttgttggaggcgtattgtctgcgggcgcggcggcggttgtggtttcgcgcgaagattgcgcggctttgggcggcgcgttgaaagtcgatgacacgcttgccgcgttgcaaacgttggcgaaggcgtggcgcgataatgtgaacccgtttgtgttcggcattaccggttcgggcggcaagacgacggtgaaggagatgctggctgcggtattgcgccgccgtttcggcgatgatgccgtttcggcgacggcaggcaacttcaacaaccacatcggattgccgctgactttattgaaattaaacgaaaaacaccgctatgccgtgattgaaatgggcatgaaccattttggcgaactggcggttttaacgcaaatcgccaaacccgatgccgctttggtcaacaacgccctgcgcgcccatgtcggatgcggtttcgacggagtgggcgatattgccaaagcgaaaagcgagatttatgcaggcttatgttcagacggcatggcactgattcctcaagaagatgccaatatggctgtcttcaaaacggcaacgtttaatttgaatacgtgcactttcggcgtcgatagcggcgatgtccgcgcggaaaatatcgtgctgaaacctttgtcgtgcgaatttgatttggtgtgcggcgacgagcgcactgccgtggtgctgcctgttcccggccgccacaatgtccacaacgccgccgctgccgccgcgctggctttggctgccggtttgagtttgaacgatgtggcggaaggtttgcaaggcttcagcaacatcaaaggccgtctgaacgtcaaagccggcatcaagggcgcaaccctgattgacgatacttataatgcgaatcccgacagtatgaaagccgcggttgacgtgttggcgcgtatgcctgcgccgcgcattttcgtgatgggcgatatgggcgaactgggcgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgagccacgatttgcccgaacgcgccaccgtgttggtgaaaggttcgcgctttatgcagatggaagaagtggtcgaggcattggaggataag

SEQ ID NO: 7694 - protein, 436 aa, Neisseria gonorrhoeae
MPSENKPVSRIVTDSRDIREGDVFFALAGGRFDAHDFVGGVLSAGAAAVVVSREDCAALGGALKVDDTLAALQTLAKAWRDNVNPFVFGITGSGGKTTVKEMLAAVLRRRFGDDAVSATAGNFNNHIGLPLTLLKLNEKHRYAVIEMGMNHFGELAVLTQIAKPDAALVNNALRAHVGCGFDGVGDIAKAKSEIYAGLCSDGMALIPQEDANMAVFKTATFNLNTCTFGVDSGDVRAENIVLKPLSCEFDLVCGDERTAVVLPVPGRHNVHNAAAAAALALAAGLSLNDVAEGLQGFSNIKGRLNVKAGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLSHDLPERATVLVKGSRFMQMEEVVEALEDK

SEQ ID NO: 7695 - DNA, 744 bp, Neisseria gonorrhoeae
ttgcgcggtaaacttacatcattaaaaaattctatgatggtttatataatgaatgccttcgatataaagtcgacaaagatggacgtattgtctatatctttgcatacatcagacttgtttgatttggaagatgtgctggtcaaattgggcaagaagtttcaagagtctggtgttgttccatttgttctggatgttcaagaatttgattatcccgagtctttggatcttgctgcattggtttcgttgttttcaaggcatggtatgcaaattttgggtctgaagcattctaatgaacgttgggctgctgtggctatgaagtatcatttgctgttttgtctgtctcattcggaaaatgttaaagaactgggtcaggttgaggtgcagaaaacggaggatggtcagaaagcaaggaaaacagtattgattacatcccctgtccgtaccggtcagcaggtttatgccgaagatggcgatttgattgttacgggggcggtcagccagggggcggaattgattgcagatggcaatatgcatatttatgcgccgatgagagggcgtgctttggccggcgccaaaggtgatacttctgcccgcatatttatccactccatgcaggcggagttggtttctgtcgcggggatttaccgtaattttgaacaggatttgccggaccatctgcacaagcagccggtacagatattgttgcaggataaccgattggttatcagtgcaattggctcagag

SEQ ID NO: 7696 - protein, 248 aa, Neisseria gonorrhoeae
LRGKLTSLKNSMMVYIMNAFDIKSTKMDVLSISLHTSDLFDLEDVLVKLGKKFQESGVVPFVLDVQEFDYPESLDLAALVSLFSRHGMQILGLKHSNERWAAVAMKYHLLFCLSHSENVKELGQVEVQKTEDGQKARKTVLITSPVRTGQQVYAEDGDLIVTGAVSQGAELIADGNMHIYAPMRGRALAGAKGDTSARIFIHSMQAELVSVAGIYRNFEQDLPDHLHKQPVQILLQDNRLVISAIGSE

SEQ ID NO: 7697 - DNA, 147 bp, Neisseria gonorrhoeae
gtcggtagagcagcggacttttaatccgttggtcgagcgttcgaatcgctcacgacccaccagataaagcaaaaaagctgagttttcaaaactcggctttttttgtcttccgacaatccttgttcggaaagcgcggcatttcgtcaa

SEQ ID NO: 7698 - protein, 7 aa, Neisseria gonorrhoeae
VGRAADF

SEQ ID NO: 7699 - DNA, 135 bp, Neisseria gonorrhoeae
ttgaattggttgacaaaccggctgctgagtaattttagtcatataacgccatctgccgaaaagcaggtggcgttatttttgcaatatctgatagataatatggtattggctatcatgtttaaaatattaattgaa

SEQ ID NO: 7700 - protein, 45 aa, Neisseria gonorrhoeae
LNWLTNRLLSNFSHITPSAEKQVALFLQYLIDNMVLAIMFKILIE

SEQ ID NO: 7701 - DNA, 180 bp, Neisseria gonorrhoeae
aaactcggctttttttgtcttccgacaatccttgttcggaaagcgcggcatttcgtcaaattctttggtgcggcttccgtatttttcccgaaaatcccttataattccgcctctgcaaccttcatcgggtgatgctttatgcgttgtcccgagtattgaaatattatagtggattaacaa

SEQ ID NO: 7702 - protein, 43 aa, Neisseria gonorrhoeae
KLGFFCLPTILVRKARHFVKFFGAASVFFPKIPYNSASATFIG

SEQ ID NO: 7703 - DNA, 1644 bp, Neisseria gonorrhoeae
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggcgctttggcttcggttgtatttttattattattggcacgcggcttcccgcgcgtttcttcagttgttttactgatttacgtcggcacaaccgccctatatttgccggtcggctggctgtatggtgcgccttcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatctgtgggggtatttgctgacgtaaaaaactataaacgtcgcagcaaaatatggctgaccatattattgactttgattttgtcctgcgcggtgatggagaaaatcgctggcgataaagattggcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataaaaattatgttgtggttatcggtgagagcgcgcgttcggattatatgaatgtttacggtttcccattgcccgatacgccttttttgagtcggaccaaagggctgttgataaacggttaccaatcgaccgcccacgcgacgaatctttcgctgccgcagactttggggctgccgggagagccgaacaataacattgtcagcttggcgaagcaggcgggttttcggacggcgtggctgtctaatcaaggaatgttggggcattttgccaacgaaatttccacctatgccctacgcagcgattatccgtggtttacccaaaggggtgattatggcaaaagcgcggggttgagcgaccgccttttgttgccggcgttcaaacgggttttgacaggaaatgcaggcacgaagcctcggctgattgtgatgcacctgatgggttcgcacagtgatttttgcacacgtttggataaggatgcgcggcggtttcagtatcaaactgaaaaaatatcctgctatgtttccaccatcgcgcaaaccgataaatttttagaagatacggttaagatattgaatgaaaataaagaaagctggtctttggtttacttttccgaccacggtttgatgcatgtcggcaaaggcggcgagcgaacgttgacacacggcgagtggaagcgtcaaagctacggcgtgccgctggttaaaatttcgtccgatgacacgcggcgcgaaatgattaaagtgaggcgcagcgcgtttaattttttacgcggattcggcagttggacgggtatcgaaaccgacgagttgcccgatgacggctatgatttttgggggaatgtccccgatgtgccgggcgaaggcaataaccttgcctttatcgacagacagtccgacgaccccgcgccgtggtatgcgggaaaaggcaaatcggctaaaaatacgtctaaaaaa

SEQ ID NO: 7704 - protein, 548 aa, Neisseria gonorrhoeae
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSVGVFADVKNYKRRSKIWLTILLTLILSCAVMEKIAGDKDWREPDAGLLLNIFDLYYDLASAPAQYAAKRAHILEAAKKASTWHIRHVAPKYKNYVVVIGESARSDYMNVYGFPLPDTPFLSRTKGLLINGYQSTAHATNLSLPQTLGLPGEPNNNIVSLAKQAGFRTAWLSNQGMLGHFANEISTYALRSDYPWFTQRGDYGKSAGLSDRLLLPAFKRVLTGNAGTKPRLIVMHLMGSHSDFCTRLDKDARRFQYQTEKISCYVSTIAQTDKFLEDTVKILNENKESWSLVYFSDHGLMHVGKGGERTLTHGEWKRQSYGVPLVKISSDDTRREMIKVRRSAFNFLRGFGSWTGIETDELPDDGYDFWGNVPDVPGEGNNLAFIDRQSDDPAPWYAGKGKSAKNTSKK

SEQ ID NO: 7705 - DNA, 366 bp, Neisseria gonorrhoeae
atgcgtcatcgtaatggcaatcgcaaattaaaccgtaccagcagtcatcgtgctgcaatgctgcgtaatatggcgaattcattattgactcacgaaactattgtaacaactctgcctaaggccaaggaattgcgccgtgtagtagagccgttgattacattgggtaaaaagccgtcattggcaagccgccgtttggcatttgaccgtactcgcgaccgtgatgttgtagtaaaactgtttggcgatttgggtcctcgttttactgctcgtaacggtggttatgttcgagtgttgaaatacggattccgtaaaggtgataatgcacctctggcactggttgaattggttgacaaaccggctgctgag

SEQ ID NO: 7706 - protein, 122 aa, Neisseria gonorrhoeae
MRHRNGNRKLNRTSSHRAAMLRNMANSLLTHETIVTTLPKAKELRRVVEPLITLGKKPSLASRRLAFDRTRDRDVVVKLFGDLGPRFTARNGGYVRVLKYGFRKGDNAPLALVELVDKPAAE

SEQ ID NO: 7707 - DNA, 1251 bp, Neisseria gonorrhoeae
gtggataaactgaaaatctccgcaaacggcccgctcaacggggaaataacggtctcgggcgcgaaaaacgcggcattgccgctgatgtgcgcgggtttgctgacatcgggtacgttgcgcctgaaaaatgtgcctatgctggcagatgtgaaaaccacgcaaaagctgcttcaggggatgggcgcgcgcgtcctgaccgacaatatcagcgaatttgaaatcaacggcggtacggtaaacaatacctgcgcgccgtatgagctggtcagaactatgcgcgcctcgattttggtgcttggcccgacgctggcgcgtttcggcgaggcgcaagtcagcctgccgggcggctgcgccatcggttcgcgccccgtcgatcagcatttgaaaggcttggaagcgatgggggcggaaatcgtcatcgaacacggttacgtcaaagccaaaggcaaactcaaaggtacgcgcgtggcgatggatgtcgttaccgtcggcggcacggaaaacctgctgatggcggcgacgctggcggaaggtacgacggttttggaaaactgcgccatcgagcctgaagtggtcgatttggcggaatgcctggtcaaaatgggcgcgaaaatcagcggcatcggtacgtccacaatgattgtggaaggtgtggacgagctgcacggctgcgaacacagcgttgtccccgaccggattgaagcggggacgttcctgtgtgcggtggcgataaccggcggcagggtggttttgcggaatgctgcgccgaaaacgatggaagtggtgttggacaaactggttgaggcaggtgcggtgattgaggcgggcgacgattggatcgccatcgatatgcggcagcgtccgaaggcggtggacatccgcacggtcgtccaccccggcttccccacggatatgcaggcgcagtttatggcattgaatgccgtggcggagggaagctgccgcgtggtggaaacgatttttgaaaaccgctttatgcacgtccccgagttgaaccggatgggggcgaacattacaaccgagggcaatacggcatttgtgcagggtgtggaacggctttccggcgcagtcgtcaaggcgacggatttgcgtgcgtccgcaagcctcgttatcgccggtttggcggcgcgcggcgaaaccgtggtcgaacagatttaccacttggatcgcggttatgaaaatattgaaaaaaaactcggcagcgtcggcgcgaaaatcgagcgcgtatccggc

SEQ ID NO: 7708 - protein, 417 aa, Neisseria gonorrhoeae
VDKLKISANGPLNGEITVSGAKNAALPLMCAGLLTSGTLRLKNVPMLADVKTTQKLLQGMGARVLTDNISEFEINGGTVNNTCAPYELVRTMRASILVLGPTLARFGEAQVSLPGGCAIGSRPVDQHLKGLEAMGAEIVIEHGYVKAKGKLKGTRVAMDVVTVGGTENLLMAATLAEGTTVLENCAIEPEVVDLAECLVKMGAKISGIGTSTMIVEGVDELHGCEHSVVPDRIEAGTFLCAVAITGGRVVLRNAAPKTMEVVLDKLVEAGAVIEAGDDWIAIDMRQRPKAVDIRTVVHPGFPTDMQAQFMALNAVAEGSCRVVETIFENRFMHVPELNRMGANITTEGNTAFVQGVERLSGAVVKATDLRASASLVIAGLAARGETVVEQIYHLDRGYENIEKKLGSVGAKIERVSG

SEQ ID NO: 7709 - DNA, 984 bp, Neisseria gonorrhoeae
atgcagaatagcacaaccgaatttttgaaacctcgtcaaattgatgtaaatactttttctgcaactcgtgcaaaagtatctatgcagccatttgaacgtggtttcggtcataccttaggtaatgctttgcgccgtatcttactgtcatccatgaatggttttgctcctactgaagtagctattgccggtgtattgcacgaatattctactgttggtggtgttcaggaagatgttgttgacattttgctgaatattaaaggtattgtgtttaaactccatggtcgtagccaagttcaacttgtgttgaagaaatcaggttcaggtgtcgtatctgccggtgatattgagttgccgcatgatgtagaaattctgaatcctggtcatgtcatttgtcatttggctgataacggtcaaattgaaatggaaattaaagtagagcaaggtcgtggttatcaatctgtttcaggtcgtcaggtagttcgtgatgagaaccgtcagattggtgcaatccagttggatgcgagcttttcgcccatcagccgtgttagctttgaggttgaacctgcacgtgtagagcagcggacggatcttgataagttggttttggatatcgaaaccgacggttctattgatcctgaggaagctgtacgcagtgcggcacgtattttgattgatcagatgtctatttttgctgatttgcagggtactcctgtggaggaggttgaagaaaaatcacctcctatcgaccctgttcttttgcatccggtggatgatctggaattgacagtacgttcagctaattgtttgaaagctgaggatatttattatattggcgatttgattcaacgcactgaaaccgagcttcttaaaacgccgaatttgggacgtaaatctttgaatgagattaaggaagtattggcatctaaaggtttgacactgggttctaagttggaagcatggccacctgtaggcttggaaaagcct

SEQ ID NO: 7710 - protein, 328 aa, Neisseria gonorrhoeae
MQNSTTEFLKPRQIDVNTFSATRAKVSMQPFERGFGHTLGNALRRILLSSMNGFAPTEVAIAGVLHEYSTVGGVQEDVVDILLNIKGIVFKLHGRSQVQLVLKKSGSGVVSAGDIELPHDVEILNPGHVICHLADNGQIEMEIKVEQGRGYQSVSGRQVVRDENRQIGAIQLDASFSPISRVSFEVEPARVEQRTDLDKLVLDIETDGSIDPEEAVRSAARILIDQMSIFADLQGTPVEEVEEKSPPIDPVLLHPVDDLELTVRSANCLKAEDIYYIGDLIQRTETELLKTPNLGRKSLNEIKEVLASKGLTLGSKLEAWPPVGLEKP

SEQ ID NO: 7711 - DNA, 1215 bp, Neisseria gonorrhoeae
attcactatacaagtacccactaggaaagaacaaacgtggataaactgaaaatctccgcaaacggcccgctcaacggggaaataacggtctcgggcgcgaaaaacgcggcattgccgctgatgtgcgcgggtttgctgacatcgggtacgttgcgcctgaaaaatgtgcctatgctggcagatgtgaaaaccacgcaaaagctgcttcaggggatgggcgcgcgcgtcctgaccgacaatatcagcgaatttgaaatcaacggcggtacggtaaacaatacctgcgcgccgtatgagctggtcagaactatgcgcgcctcgattttggtgcttggcccgacgctggcgcgtttcggcgaggcgcaagtcagcctgccgggcggctgcgccatcggttcgcgccccgtcgatcagcatttgaaaggcttggaagcgatgggggcggaaatcgtcatcgaacacggttacgtcaaagccaaaggcaaactcaaaggtacgcgcgtggcgatggatgtcgttaccgtcggcggcacggaaaacctgctgatggcggcgacgctggcggaaggtacgacggttttggaaaactgcgccatcgagcctgaagtggtcgatttggcggaatgcctggtcaaaatgggcgcgaaaatcagcggcatcggtacgtccacaatgattgtggaaggtgtggacgagctgcacggctgcgaacacagcgttgtccccgaccggattgaagcggggacgttcctgtgtgcggtggcgataaccggcggcagggtggttttgcggaatgctgcgccgaaaacgatggaagtggtgttggacaaactggttgaggcaggtgcggtgattgaggcgggcgacgattggatcgccatcgatatgcggcagcgtccgaaggcggtggacatccgcacggtcgtccaccccggcttccccacggatatgcaggcgcagtttatggcattgaatgccgtggcggagggaagctgccgcgtggtggaaacgatttttgaaaaccgctttatgcacgtccccgagttgaaccggatgggggcgaacattacaaccgagggcaatacggcatttgtgcagggtgtggaacggctttccggcgcagtcgtcaaggcgacggatttgcgtgcgtccgcaagcctcgttatcgccggtttggcggcgcgcggcgaaaccgtggtcgaacagatttaccac

SEQ ID NO: 7712 - protein, 7 aa, Neisseria gonorrhoeae
IHYTSTH

SEQ ID NO: 7713 - DNA, 1476 bp, Neisseria gonorrhoeae
atgttcagcaagttaagccctttggctgaaaccggcatcccgaccctgtcgtgtgcaaacgcggcagggcgtttgttgcattcagacagccgccaaatcaaacaaggcgatattttcgttgcctgtccgggcgaatatgccgacggacgcagttatatccccgccgccgttgccaacggcgcggcttttgttttttgggacgacgacggcagattcgcgtggaatcccgaatggaaagtccccaatcaaggcatcaaagatttgaaacaccgtgccggcatattggcggcacaggtttacggcaacgtttcagacggtctcaaagtctggggcgtaaccggaaccaacggcaaaacctccatcacgcaatggctggcgcaagccgccgatttgttgggcgaaaaaaccgccattatcggcacggtcggcaacggcttttggggtgcattggaagaaaccgcgcacaccacccccgcccccgtcgatgtccaaaccctgctctaccgtttccgtcaacaaggcgcaacagccgccgcgatggaagtttccagccacggccttgaccagtcgcgagtcaacggcgtgccgttccgcagcgcaatcttcaccaacctcacccgagaccacctcgactaccacggcacgatggaagcctacggtgctatcaagtcgcgcctgttttactggcacggcttgaaacacgccgttatcaataccgatgacggatacggcgcggaactcgcaggtcgtctgaaaaaagactgtcccgatttagccgtttacagctatggtttcagcgaacacgccgacatccgcattaccgactttaccgcctcttcagacggcatggaagcagtattccaaaccccgtggggcgaaggaaaatgccgcacccgcctgctcggacggttcaacgcgcaaaacctcgccgcctgcatcgccttgctttgtgccaacggttatccgcttgataaggtattggatgtgctggcaaaaatccgtcccgcttcagggcgcatggactgcatcatgaacagcggcaagcccttggtcgttgtcgattacgcccacacgcccgacgcattggaaaaagcactctccactttgcaggaaatcaaaccgcagggtgcggccttatggtgcgtattcggttgcggcggcaaccgcgattgcggcaaacgcccattgatgggcgcggcagccgtacagggcgcggataaagtcgtcgtaaccagcgacaacccgcgtttggaaaatccgcacgacatcatcaacgacatcctgcccgccgtgcccgcgcccgaatgcgtcgaagccgaccgcgccgccgccatccgttatgcggttgagcaggccgccgcaaacgacatcatcctgattgccggcaaaggacacgaaaactatcaggatgtacagggcgtgaagcaccgtttttccgatcttgaaatcgtcgggcaggctttgttaactcgtaaa

SEQ ID NO: 7714 - protein, 492 aa, Neisseria gonorrhoeae
MFSKLSPLAETGIPTLSCANAAGRLLHSDSRQIKQGDIFVACPGEYADGRSYIPAAVANGAAFVFWDDDGRFAWNPEWKVPNQGIKDLKHRAGILAAQVYGNVSDGLKVWGVTGTNGKTSITQWLAQAADLLGEKTAIIGTVGNGFWGALEETAHTTPAPVDVQTLLYRFRQQGATAAAMEVSSHGLDQSRVNGVPFRSAIFTNLTRDHLDYHGTMEAYGAIKSRLFYWHGLKHAVINTDDGYGAELAGRLKKDCPDLAVYSYGFSEHADIRITDFTASSDGMEAVFQTPWGEGKCRTRLLGRFNAQNLAACIALLCANGYPLDKVLDVLAKIRPASGRMDCIMNSGKPLVVVDYAHTPDALEKALSTLQEIKPQGAALWCVFGCGGNRDCGKRPLMGAAAVQGADKVVVTSDNPRLENPHDIINDILPAVPAPECVEADRAAAIRYAVEQAAANDIILIAGKGHENYQDVQGVKHRFSDLEIVGQALLTRK

SEQ ID NO: 7715 - DNA, 618 bp, Neisseria gonorrhoeae
atggcacgttatattggccctaaatgtaagttggcacgtcgcgaaggtacggatttgtttttgaagagtgcgcgccgctctttggattctaaatgtaaaattgattccgctcccggtcagcatggtgcaaaaaaaccgcgtttgtcagactatggtttgcagttgcgtgaaaaacaaaaaatccgccgtatttatggcgtattagaacgtcagttccgtcgttatttcgcagaagctgatcgccgtaaaggttctactggcgagttgctgttgcagttgctggaatctcgtttggataatgtcgtttatcgtatgggtttcggttctacccgagctgaagcaagacagcttgtttctcataaggctatagttgtaaatggacaagttgtcaatattccttctttccaagtgaaagctggtgatgttgtctcagttcgtgaaaaagccaaaaaacaggtacgtattcaagaagcattgggtttggcaactcaaatcggcttgccgggttgggtttctgtagatgcagataaacttgagggtgtgttcaaaaacatgccggatcgctctgaattgaccggtgatattaatgaacagctggtggtagagttctactctaaa

SEQ ID NO: 7716 - protein, 206 aa, Neisseria gonorrhoeae
MARYIGPKCKLARREGTDLFLKSARRSLDSKCKIDSAPGQHGAKKPRLSDYGLQLREKQKIRRIYGVLERQFRRYFAEADRRKGSTGELLLQLLESRLDNVVYRMGFGSTRAEARQLVSHKAIVVNGQVVNIPSFQVKAGDVVSVREKAKKQVRIQEALGLATQIGLPGWVSVDADKLEGVFKNMPDRSELTGDINEQLVVEFYSK

SEQ ID NO: 7717 - DNA, 201 bp, Neisseria gonorrhoeae
atgccgtctgaagccttcagacggcatcaattgtttctgtatcgcaaacaccgattaaaaaggactgattatggcatttttaaaactgaccgaacaaaacgtgcagggcaaaaccgtcctcatccgcgccgatatgaacgtgccgttcaaagacggcaaaatcagcgacgacacccgtatccgcgcctcgattgcgtccgt

SEQ ID NO: 7718 - protein, 67 aa, Neisseria gonorrhoeae
MPSEAFRRHQLFLYRKHRLKRTDYGIFKTDRTKRAGQNRPHPRRYERAVQRRQNQRRHPYPRLDCVR

SEQ ID NO: 7719 - DNA, 393 bp, Neisseria gonorrhoeae
atggctaaagcaaacacagcttcacgtgtacgtaaaaaagtacgtaaaaccgtgagtgagggtattgtgcacgttcatgcatctttcaacaataccatcattacaatcactgaccgtcaaggcaatgcgttgtcttgggctacctctggcggcgctggttttaaaggttctcgtaaaagtacaccatttgcagcacaagttgcagcagaagcagctggtaaagttgcccaagagtatggcgttaaaaatttagaggttcgtattaaaggtccaggtccaggtcgcgaatcctctgtacgtgctttgaatgctcttggtttcaagattaccagcattactgacgttaccccgttgcctcataacggttgccgtccgcctaaaaaacgtcgtatt

SEQ ID NO: 7720 - protein, 131 aa, Neisseria gonorrhoeae
MAKANTASRVRKKVRKTVSEGIVHVHASFNNTIITITDRQGNALSWATSGGAGFKGSRKSTPFAAQVAAEAAGKVAQEYGVKNLEVRIKGPGPGRESSVRALNALGFKITSITDVTPLPHNGCRPPKKRRI

SEQ ID NO: 7721 - DNA, 1035 bp, Neisseria gonorrhoeae
gtggacaacggcgcgtccgtcattgtgatgacccacttgggccgcccgaccgaaggcgaattccatcccgaagacgacgttgcgcccgttgccgcacacttgggcagcctgttgggcaaagacgtgaaagtattgaacgactggcgcgaaaacaaaccggctttgaacgcgggcgatgtcgtgatgctgcaaaacgtgcgtatcaacaaaggcgagaagaaaaacgatttggaactgggcaaagcctacgcttctttgtgcgacgtgttcgtcaatgacgcgttcggcaccgcgcaccgcgcccaagcctcgaccgaagccgtcgctcaagccgcgcccgttgcctgcgccggcgtattgatggcgggcgaactcgacgctttgggcaaagccctgaaacagcctgcacgcccgatggttgccatcgttgccggcagcaaagtgtccaccaagttgaccattctcgaatcgctggcggacaaagtcgaccaactcatcgtcggcggcggcatcgccaacaccttcctgttggcagaaggcaaagccatcggcaaatctttggcggaacacgatttggtggaagaatccaaaaaaattatggcgaaaatggcggctaaaggcggctccgtaccgctgccgaccgatgtcgtcgttgccaaagcctttgccgccgatgccgaagcggtcgtgaaagacattgccgacgttgccgaagacgatatgattttggacatcggcccgaaatccgccgccgcgcttgccgatttgcttaaagccgccgacacggtcgtttggaacgggccggtcggcgtgttcgagtttgaccaattcgcaggcggtacgaaagcccttgccgaagccattgcccaaagcaaagcgttctcgattgcgggcggcggcgacacgctggcagcgattgccaaattcggcgttaccgaacaaatcggctacatctccaccggaggcggcgcgttccttgagttcttggaaggcaaagagctgcctgccgtagctgctttggaaaaacgcggcgcg

SEQ ID NO: 7722 - protein, 345 aa, Neisseria gonorrhoeae
VDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDDMILDIGPKSAAALADLLKAADTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 7723 - DNA, 1716 bp, Neisseria gonorrhoeae
atgctgcccaaagaagagcaggtcaaaaagccgatgaccagtaacggacggattagcttcgtcctgatggcaatggcggtcttgtttgcctgtctgattgcccgcgggctgtatctgcagacggtaacgtataactttttgaaagaacagggcgacaaccggattgtgcggactcaagcattgccggctacacgcggtacggtttcggaccggaacggtgcggttttggcgttgagcgcgccgacggagtccctgtttgccgtgcctaaagatatgaaggaaatgccgtctgccgcccaattggaacgcctgtccgagcttgtcgatgtgccggtcgatgttttgaggaacaaactcgaacagaaaggcaagtcgtttatttggatcaagcggcagctcgatcccaaggttgccgaagaggtcaaagccttgggtttggaaaactttgtatttgaaaaagaattaaaacgccattacccgatgggcaacctgtttgcacacgtcatcggatttaccgatattgacggcaaaggtcaggaaggtttggaactttcgcttgaagacagcctgtatggcgaagacggcgcggaagttgttttgcgggaccggcagggcaatattgtggacagcttggactccccgcgcaataaagcaccgcaaaacggcaaagacatcatcctttccctcgatcagaggattcagaccttggcctatgaagagttgaacaaggcggtcgaataccatcaggcaaaagccggaacggtggtggttttggatgcccgcacgggggaaatcctcgccttggccaatacgcccgcctacgatcccaacagacccggccgggcagacagcgaacagcggcgcaaccgtgccgtaaccgatatgatcgaacctggttcggcaatcaaaccgttcgtgattgcgaaggcattggatgcgggcaaaaccgatttgaacgaacggctgaatacgcagccttataaaatcggaccgtctcccgtgcgcgatgatacccatgtttacccctctttggatgtgcgcggcattatgcagaaatcgtccaacgtcggcacaagcaaactgtctgcgcgtttcggcgccgaagaaatgtatgacttctatcatgaattgggcatcggtgtgcgtatgcactcgggctttccgggggaaactgcaggtttgttgagaaattggcgcaggtggcggcccatcgaacaggcgacgatgtctttcggttacggtctgcaattgagcctgctgcaattggcgcgcgcctataccgcactgacgcacgacggcgttttgctgccgctcagctttgagaagcaggcggttgcgccgcaaggcaaacgcatattcaaagaatcgaccgcgcgcgaggtacgcaatctgatggtttccgtaaccgagccgggcggcaccggtacggcgggtgcggtggacggtttcgatgtcggcgctaaaaccggcacggcgcgcaagttcgtcaacgggcgttatgccgacaacaaacacgtcgctacctttatcggttttgcccccgccaaaaacccccgtgtgattgtggcggtaaccatcgacgaaccgactgcccacggctattacggcggcgtagtggcagggccgcccttcaaaaaaattatgggcggcagcctgaacatcttgggcatttccccgaccaagccactgaccgccgcagccgtcaaaacaccgtct

SEQ ID NO: 7724 - protein, 572 aa, Neisseria gonorrhoeae
MLPKEEQVKKPMTSNGRISFVLMAMAVLFACLIARGLYLQTVTYNFLKEQGDNRIVRTQALPATRGTVSDRNGAVLALSAPTESLFAVPKDMKEMPSAAQLERLSELVDVPVDVLRNKLEQKGKSFIWIKRQLDPKVAEEVKALGLENFVFEKELKRHYPMGNLFAHVIGFTDIDGKGQEGLELSLEDSLYGEDGAEVVLRDRQGNIVDSLDSPRNKAPQNGKDIILSLDQRIQTLAYEELNKAVEYHQAKAGTVVVLDARTGEILALANTPAYDPNRPGRADSEQRRNRAVTDMIEPGSAIKPFVIAKALDAGKTDLNERLNTQPYKIGPSPVRDDTHVYPSLDVRGIMQKSSNVGTSKLSARFGAEEMYDFYHELGIGVRMHSGFPGETAGLLRNWRRWRPIEQATMSFGYGLQLSLLQLARAYTALTHDGVLLPLSFEKQAVAPQGKRIFKESTAREVRNLMVSVTEPGGTGTAGAVDGFDVGAKTGTARKFVNGRYADNKHVATFIGFAPAKNPRVIVAVTIDEPTAHGYYGGVVAGPPFKKIMGGSLNILGISPTKPLTAAAVKTPS

SEQ ID NO: 7725 - DNA, 360 bp, Neisseria gonorrhoeae
atggctcgtattgcaggggtaaatatccctaataacgcacacatcgtaattggtcttcaggctatttacggtattggtgctactcgtgctaaattgatttgtgaggctgcaaatattgcgcctgatactaaagcaaaagatttggacgagactcaattagatgctttgcgtgatcaagttgccaagtatgaagtagaaggtgatttgcgtcgtgaagtaactatgagtatcaaacgattgatggacatgggctgctatcgtggcttccgtcatcgtcgcggcttaccatgccgcggtcaacgcactcgtacaaatgcgcgtactcgcaaaggtccgcgtaaagcgattgctggtaagaaa

SEQ ID NO: 7726 - protein, 120 aa, Neisseria gonorrhoeae
MARIAGVNIPNNAHIVIGLQAIYGIGATRAKLICEAANIAPDTKAKDLDETQLDALRDQVAKYEVEGDLRREVTMSIKRLMDMGCYRGFRHRRGLPCRGQRTRTNARTRKGPRKAIAGKK

SEQ ID NO: 7727 - DNA, 1308 bp, Neisseria gonorrhoeae
gtggctaatcaacaaacgtcatcaggttcatccaagtttggagatcttaagaaacgtcttttgtttctatttggagcattgattgtttttcgaattggtgcccatatacccgtacctggggttgatgctgttgctttagctaaattatacgaaagcgctggaaacggcatcctgggaatattgaatatgttttccggtgggtcgttagagcgctttagtatatttgcaataggaattatgccatatatttcagcttctattattgtacagctcgcttctgaaattttgccatcattgaaggctttaaaaaaagaaggggaggctggtagaaaggtaattacgaaatatactaggtatggtactgttttgttagcaattcttcaaagtctaggtgttgcatctttcgtatttcagcaaggaattgttgtaacaagttcatttgagtttcatgtttccacggtagtttctttggtaacgggaaccatgtttcttatgtggcttggggagcaaattactgaaaggggtatcgggaacggtatttctttaatcattacggcaggtattgcttcaggtattccttcgggtattgcaaagctggttacactgacgaaccaaggttctatgagcatgcttacggcgttgcttattgtatttggtgccttattattaatttatttggttgtatactttgaaagtgcacagcggaagattcctattcattatgcaaaacgccagtttaatggtagggcgggtagtcaaagtacgcatatgcctttcaagttgaatatggctggtgttattcccccaatttttgcttccagtattattctatttccatctactcttttaggttggtttggttcggctgatacaaatagtgttttgcacaaaatagctggattgttacaacacggtcaattgctgtatatggctttatttgcagcgacagttattttcttttgttatttttatacggctttggtttttagtcctaaagaaatggcagagaatttaaaaaagagtggtgcttttgttcctgggattagacctggtgagcagacctctaggtatttagaaaaagttgtattacgtttgacattgtttggagctttttatattacaactatttgtttaattccagagttcttaactacgattttaaatgtacctttttatttgggtggcacgtctttgttgattctagttgttgtaacgatggattttagtacacaaataaattcgtataggcttactcaacagtatgataagttaatgactcgttcagaaatgaaatcattttctcggaaa

SEQ ID NO: 7728 - protein, 436 aa, Neisseria gonorrhoeae
VANQQTSSGSSKFGDLKKRLLFLFGALIVFRIGAHIPVPGVDAVALAKLYESAGNGILGILNMFSGGSLERFSIFAIGIMPYISASIIVQLASEILPSLKALKKEGEAGRKVITKYTRYGTVLLAILQSLGVASFVFQQGIVVTSSFEFHVSTVVSLVTGTMFLMWLGEQITERGIGNGISLIITAGIASGIPSGIAKLVTLTNQGSMSMLTALLIVFGALLLIYLVVYFESAQRKIPIHYAKRQFNGRAGSQSTHMPFKLNMAGVIPPIFASSIILFPSTLLGWFGSADTNSVLHKIAGLLQHGQLLYMALFAATVIFFCYFYTALVFSPKEMAENLKKSGAFVPGIRPGEQTSRYLEKVVLRLTLFGAFYITTICLIPEFLTTILNVPFYLGGTSLLILVVVTMDFSTQINSYRLTQQYDKLMTRSEMKSFSRK

SEQ ID NO: 7729 - DNA, 108 bp, Neisseria gonorrhoeae
ttgggcagcatccggggcttatattcgcttttaatcaacatttttacttctcgttattattatcctgatgcaggaatccgattccggcacacaggctgcttctatctt

SEQ ID NO: 7730 - protein, 36 aa, Neisseria gonorrhoeae
LGSIRGLYSLLINIFTSRYYYPDAGIRFRHTGCFYL

SEQ ID NO: 7731 - DNA, 246 bp, Neisseria gonorrhoeae
ttgtgctttggcagcccattctgccggtgtagcggctaccgaaatggaaagtgcgtgcagttcgttgctttccagttgggctttgagtccgtctttaatcaggcggtggcgcgcgaggcgtgccttgccttcaaattctgatgaaacgatgacggcgaaaaaatggtgtccgtcgccttctacttcgatgtgttcgcattttgccacgccagcaatcagggccttgacttgttcgggtgtcagcat

SEQ ID NO: 7732 - protein, 46 aa, Neisseria gonorrhoeae
LCFGSPFCRCSGYRNGKCVQFVAFQLGFESVFNQAVAREACLAFKF

SEQ ID NO: 7733 - DNA, 432 bp, Neisseria gonorrhoeae
atgtttttgaatacaattcaacctgctgttggtgctacgcatgctggtcgtcgtgttggacgcggtattggtagtggtcttggcaaaacgggtggtcgtggtcataaaggtcaaaagagccggtctggtgggtttcataaggtgggtttcgagggtggtcaaatgcccttgcaacgacgcctccctaaaagaggttttaaatctttaacagtatcagctaatgcacagcttcgtttaagtgaactggaatcaattgctgttaatgagattgatattttagtcttaaagcaagcaggtctgattgcatctacagtctctaatgttaaagttattgcttctggtgaaatttctaaggcagttgctttgaagggtattaaagttaccaaaggtgcgagagctgctatcgaggatgttggtggtaagattgaaatg

SEQ ID NO: 7734 - protein, 144 aa, Neisseria gonorrhoeae
MFLNTIQPAVGATHAGRRVGRGIGSGLGKTGGRGHKGQKSRSGGFHKVGFEGGQMPLQRRLPKRGFKSLTVSANAQLRLSELESIAVNEIDILVLKQAGLIASTVSNVKVIASGEISKAVALKGIKVTKGARAAIEDVGGKIEM

SEQ ID NO: 7735 - DNA, 1617 bp, Neisseria gonorrhoeae
atgacggttttcaggtgttgctggaattgggggcagtggaggttgtctgaaaacaggcagatcgggcgtttatgcccaacgagaaccttattgtcactattattagggattaatacaatgaatataaaagaatttatgtctaactataccaaccatcccgttctctttattggaacaggtatgagtttgagatacttagataattcatatacttgggatggtttattatctaaaattgcaatagatttatttggagatgatagggaatatttgaacatcaaatcacggtactgtgaagatggtagattccaatatgaagagattgcagaggaattacaaagtaaatttgataaagttttagaaaatgaccctgatggtagatttaaagaaataaatgataagttctttgaaaatatgagggcgggaaacaccttgagcaggtttaagatttatatatccaccctgctctcacaattgaattataaagataattctaatacagaattatctgaattaaaaaaagcgagaaaaaatgtagggtcaatcattacaacaaattatgataaattagcccaagatatttttgaatttaacccactaattggtaatgatattcttttaagcaacccttatggctcagtatacaaaatacatggttgtgtggacgatccatcaaaaattattattaccaaaaaggattatgagaaatttaaagaaaaatatgaacttattagagcccaactattatcgttatttattcacaatccaatcatatttcttggatataatgttggtgacgaaaatatcaaagaaattttaaaaacaatctttacttatgtagaacaaaactctccttcagctaataaaattcgtaggaattttttactcgtagaatatgaacctgagtctaacaatgaagatattgttgaacatgatatagatataactggattctctactatccgtattaataaaatcaaaacagataacttctcacaaatttataaagctcttgcagaactaacactaccaatctcagctatggatgtacgtaaatttcaatctatagcaaaggagatttatactggcggtaacattaaagttagctttacggaagatatggacaatttaaataatagcgataaagtggttgctattggttcaactaaaactatcagctacaactttcaaacaacatcagagatgatgtcaaattatttcaaaataattgaagaggaaaattcacaacttctaaaattaatagataaacatagtatagcatctacgcaatattttcctatttatggatttagtaggatatgttctgatatacataaagaagctgtactaaaacgccaacaaaaagaaaaattagatcattttattgaagaaataaataggcgttgtaaaaataatcattcatccatccaatcaattttagatgatgaaaatatttcagacacatataaaaacgatgcgattgcttggggaatatggaataaccaactttcagaagatgaggttgaaaattatttaaaaaattttgtgaataaaaaaaatacgcactataaaagactactatgtatgttcgattataaaaaatatgcggatactgtc

SEQ ID NO: 7736 - protein, 539 aa, Neisseria gonorrhoeae
MTVFRCCWNWGQWRLSENRQIGRLCPTRTLLSLLLGINTMNIKEFMSNYTNHPVLFIGTGMSLRYLDNSYTWDGLLSKIAIDLFGDDREYLNIKSRYCEDGRFQYEEIAEELQSKFDKVLENDPDGRFKEINDKFFENMRAGNTLSRFKIYISTLLSQLNYKDNSNTELSELKKARKNVGSIITTNYDKLAQDIFEFNPLIGNDILLSNPYGSVYKIHGCVDDPSKIIITKKDYEKFKEKYELIRAQLLSLFIHNPIIFLGYNVGDENIKEILKTIFTYVEQNSPSANKIRRNFLLVEYEPESNNEDIVEHDIDITGFSTIRINKIKTDNFSQIYKALAELTLPISAMDVRKFQSIAKEIYTGGNIKVSFTEDMDNLNNSDKVVAIGSTKTISYNFQTTSEMMSNYFKIIEEENSQLLKLIDKHSIASTQYFPIYGFSRICSDIHKEAVLKRQQKEKLDHFIEEINRRCKNNHSSIQSILDDENISDTYKNDAIAWGIWNNQLSEDEVENYLKNFVNKKNTHYKRLLCMFDYKKYADTV

SEQ ID NO: 7737 - DNA, 1371 bp, Neisseria gonorrhoeae
ttgagtcggaggaatgtgatgagtatccaatccggcgaaattttagaaaccgtcaaaatggttgccgaccagaattttgatgtccgcaccattaccatcggcattgatttgcacgactgcatcagcaccgacatcgacgtgttaaaccaaaacatttacaacaaaatcaccacggtcggcaaagacttggtggcaacggcgaaacacctttccgccaaatacggcgtgccgattgtgaatcagcgcatttccgttacgccgattgcccaaatcgcggcggcgaccaaagccgacagttatgtcagcgtggcgcagactttggacaaggcagccaaagccatcggcgtgtcctttatcggcggcttttccgcgctggtgcaaaaaggtatgtcgccttcggatgaggtgttgatccgttccgttcccgaagcgatgaaaactaccgatatcgtgtgcagctccatcaatatcggcagcacgcgtgccggtatcaatatggatgcggtcaagctggcaggcgaaaccatcaaacgcacggctgaaatcacacccgaaggtttcggctgcgccaaaatcgtcgtgttctgcaacgcggtggaagacaatccgtttatggcgggtgcgttccacggctcgggcgaagcggatgctgtgattaatgtcggcgtatccggtccaggcgtggtcaaagccgcgctggaaaattcggacgcggtcagcctgaccgaggtcgccgaagtcgtgaagaaaaccgctttcaaaatcacccgcgtgggcgaactcatcggtcgcgaagcctcaaaaatgctgaatatcccgttcggcattctcgatttgtcgctggcaccgacccccgccgtcggcgactcggtggcgcgcattcttgaagaaatgggcttgagcgtctgcggtacgcacggcacaacagcagctttggcattgctgaacgatgccgtgaaaaagggcggcatgatggcttccagcgcggtcggcggtttgagcggcgcgtttatccccgtttccgaagacgaaggtatgattgccgccgccgaggcaggcgtgttgacgctggacaaactcgaagccatgaccgccgtctgctccgttggtttggacatgattgccgttcccggcgacacgcccgcgcacaccatttccggcatcatcgccgacgaagccgccatcggcatgatcaacagcaaaaccaccgccgtgcgcattattccggtaacgggcaaaaccgtcggcgacagcgtcgagttcggcggtctgttgggctacgcgcctgtaatgccggcaaaagaaggttcgtgcgaagtgttcgtcaaccggggcggcaggattcccgcaccggttcaatcgatgaaaaac

SEQ ID NO: 7738 - protein, 457 aa, Neisseria gonorrhoeae
LSRRNVMSIQSGEILETVKMVADQNFDVRTITIGIDLHDCISTDIDVLNQNIYNKITTVGKDLVATAKHLSAKYGVPIVNQRISVTPIAQIAAATKADSYVSVAQTLDKAAKAIGVSFIGGFSALVQKGMSPSDEVLIRSVPEAMKTTDIVCSSINIGSTRAGINMDAVKLAGETIKRTAEITPEGFGCAKIVVFCNAVEDNPFMAGAFHGSGEADAVINVGVSGPGVVKAALENSDAVSLTEVAEVVKKTAFKITRVGELIGREASKMLNIPFGILDLSLAPTPAVGDSVARILEEMGLSVCGTHGTTAALALLNDAVKKGGMMASSAVGGLSGAFIPVSEDEGMIAAAEAGVLTLDKLEAMTAVCSVGLDMIAVPGDTPAHTISGIIADEAAIGMINSKTTAVRIIPVTGKTVGDSVEFGGLLGYAPVMPAKEGSCEVFVNRGGRIPAPVQSMKN

SEQ ID NO: 7739 - DNA, 93 bp, Neisseria gonorrhoeae
ttgaatatagacggcttacgggtctttgtttcgcgcaaagcaagggctaaggcagtcaggcagcaaatcccgcaatgtattaaaacagacgcg

SEQ ID NO: 7740 - protein, 31 aa, Neisseria gonorrhoeae
LNIDGLRVFVSRKARAKAVRQQIPQCIKTDA

SEQ ID NO: 7741 - DNA, 195 bp, Neisseria gonorrhoeae
atgcagaaagtctatgttgtccagtccgtatcaacaggggactttctgtatctctctcctgaaacgggcgacatcggacataccaaattaattaccaatgccgattatttctacgacttcgaagaagcggttaacgcaggtttggaagaaatcggcaaccaatgcgaatttgtcgtattcggatttttgaaagac

SEQ ID NO: 7742 - protein, 65 aa, Neisseria gonorrhoeae
MQKVYVVQSVSTGDFLYLSPETGDIGHTKLITNADYFYDFEEAVNAGLEEIGNQCEFVVFGFLKD

SEQ ID NO: 7743 - DNA, 462 bp, Neisseria gonorrhoeae; identical to SEQ ID NO: 101

SEQ ID NO: 7744 - protein, 154 aa, Neisseria gonorrhoeae; identical to SEQ ID NO: 102

SEQ ID NO: 7745 - DNA, 261 bp, Neisseria gonorrhoeae
atgaacaaatcgaatttctttctgctgcttgcggtgtgcgtttccgctttttccgttgtgatgcagcaaaaccagtacaggctcaacttcacagctttggacaaggcgaaaaaacaggaaatcgccttggagcaggattatgcgcaaatgaggctgcaacaggcgcgtttggcgaatcacgaagcgatcagggcggcggcagaaaaacaaaacctccatccgccggtttcgggcaatacctttatggtggaacatcaaaga

SEQ ID NO: 7746 - protein, 87 aa, Neisseria gonorrhoeae
MNKSNFFLLLAVCVSAFSVVMQQNQYRLNFTALDKAKKQEIALEQDYAQMRLQQARLANHEAIRAAAEKQNLHPPVSGNTFMVEHQR

SEQ ID NO: 7747 - DNA, 183 bp, Neisseria gonorrhoeae
atggctgaacaaaaaaagattagggttacattggttaaaagcctgattggtacaattgaatctcatcgtgcatgtgcacgcggtttaggtttgcgtcgtcgcgagcatacggtagaggttttagatacctctgaaaaccgtggtatgattaataaaatcagctacttgttgaaagtggagtct

SEQ ID NO: 7748 - protein, 61 aa, Neisseria gonorrhoeae
MAEQKKIRVTLVKSLIGTIESHRACARGLGLRRREHTVEVLDTSENRGMINKISYLLKVES

SEQ ID NO: 7749 - DNA, 915 bp, Neisseria gonorrhoeae
ttttttggctttgaagccgagcaggtgctgggtggtggcaagccacgcgccgaatatccccagtgcgatgacgaagccgaacaccagtgcgatttctcccgggtagaagaaacgccagccgatattaagtccgtagggtttgaagatggcatcgaccaaggggcgcacggcagagagcagccaaccgcaaagccccaagctgacggcggcggaaaggatgctctgccacatggcttgataaaggaatgggcggcggataaacgacgcgggcgcgcccaagagtttggtgatttcgatttcttcttttcggctgaggatttgcagtcggatggtgttgtgcgcgacaaggacgaacgccatccccagcgtcagggaaagaaaccataagattttacggatgaattcgttgatttggtacagtgtctgtacccattccgtatccatgttggcggattcgaccataggcagtttggtaatgtcccggtagattgcctgcatttgggcgggcgtggttgccgggtcgggggtaacgataaagacatccggcagggggttaccgtcaagcatggaaatcagattttggtcgagattggactgtaattcttccaaaccgtcttctttgctgataaagcggatgttgtcgagccgtttgtcgcgcaccagcaggctgcggacggtatcgctgtcgctttgtgcggcggcggtttccatatagacggtgatttgcggcgactcattgagtttgcccaacacgctttgcccgctttggatgcccaagtacataaacagcggcagggtcatggcgacggcgagcattatgagggtaagcagtgtgccgaaaggttggcgcagaagctgtttgagcgcggtgcgcgcggattcgacgtgcagcgagaggtagtggatgatgctcat

SEQ ID NO: 7750 - protein, 128 aa, Neisseria gonorrhoeae
FFGFEAEQVLGGGKPRAEYPQCDDEAEHQCDFSRVEETPADIKSVGFEDGIDQGAHGREQPTAKPQADGGGKDALPHGLIKEWAADKRRGRAQEFGDFDFFFSAEDLQSDGVVRDKDERHPQRQGKKP

SEQ ID NO: 7751 - DNA, 396 bp, Neisseria gonorrhoeae
gtgtggcggagcggactgccggtccgataccggaataataacagagaaaaacgtctgaacggcaatgaacaaatcgaatttctttctgctgcttgcggtgtgcgtttccgctttttccgttgtgatgcagcaaaaccagtacaggctcaacttcacagctttggacaaggcgaaaaaacaggaaatcgccttggagcaggattatgcgcaaatgaggctgcaacaggcgcgtttggcgaatcacgaagcgatcagggcggcggcagaaaaacaaaacctccatccgccggtttcgggcaatacctttatggtggaacatcaaagatagaagcagcctgtgtgccggaatcggattcctgcatcaggataataataacgagaagtaaaaatgttgat

SEQ ID NO: 7752 - protein, 132 aa, Neisseria gonorrhoeae
VWRSGLPVRYRNNNREKRLNGNEQIEFLSAACGVRFRFFRCDAAKPVQAQLHSFGQGEKTGNRLGAGLCANEAATGAFGESRSDQGGGRKTKPPSAGFGQYLYGGTSKIEAACVPESDSCIRIIITRSKNVD

SEQ ID NO: 7753 - DNA, 468 bp, Neisseria gonorrhoeae
atggtcgcagttaaccgtgtaaccaaagtagttaaaggtggtcgcattatggctttctctgcgctaactgttgttggtgatggagatggtcgtattggtatgggtaaaggtaagtcaaaagaagtgcctgttgcagtccaaaaggcgatggatcaagcacgacgctctatgattaaggtaccattaaaaaatggtacgatccatcatgaggttattggtcgacatggtgctactaaagtatttatgcagcctgctaaagagggtagtggcgtaaaagccggtggacctatgcgtttggtttttgatgctatgggcattcataatatttccgccaaagtgcacggatctactaacccatataatatcgtacgtgcaacattagatggtttgtctaagttgcatactcctgctgatatcgcagccaaacgtggcttgacagtggaagacattttgggagttaaccatggc

SEQ ID NO: 7754 - protein, 156 aa, Neisseria gonorrhoeae
MVAVNRVTKVVKGGRIMAFSALTVVGDGDGRIGMGKGKSKEVPVAVQKAMDQARRSMIKVPLKNGTIHHEVIGRHGATKVFMQPAKEGSGVKAGGPMRLVFDAMGIHNISAKVHGSTNPYNIVRATLDGLSKLHTPADIAAKRGLTVEDILGVNHG

SEQ ID NO: 7755 - DNA, 720 bp, Neisseria gonorrhoeae
tgcgagtcgtcctttcgagaggcgcaggatgcggtgtccgtagtccgccatcagggtttcgtcatgtgcggcgacgatgacggttgttcccgcttcgtggaaggttttgaacaattccataatatcgagcgcgtaggcgcggtcgaggttggcggagggttcgtcggcaatcagcaggctgggctggtgaacgacggcgcgggcgatgcacaggcgttgttgttcaccgccggagagggttacgggatcgtccaattctcgtcctttcaggccgactttttcgatggcgatgcgggcacgctcttcggctttgcgcggcggatagccgataatccgaagcggcaggatgacgttttgcaggacgttgcggtcgtagaggattttgtggtcttggaacacgatgccgatgtgttggcgcataaagccgatttggttgtcggacaatgtgccgagatcctgcccgttaaacaggattttgcccctgctcggcttggtgatgcccgaaatcagcttgaggacggtggatttgcccgaaccggagtgtcccgcgataaatatcatttcgcctttgttgatttggaagctgacgtttttcagggcttcaaaaccgccgggataggttttggaaacttgttcgaaacggatcataggaggtcctgtaaggaagggcggcatatcgtttcgggcggttgcgtccgcagggatatgccgtctgaacaa

SEQ ID NO: 7756 - protein, 240 aa, Neisseria gonorrhoeae
CESSFREAQDAVSVVRHQGFVMCGDDDGCSRFVEGFEQFHNIERVGAVEVGGGFVGNQQAGLVNDGAGDAQALLFTAGEGYGIVQFSSFQADFFDGDAGTLFGFARRIADNPKRQDDVLQDVAVVEDFVVLEHDADVLAHKADLVVGQCAEILPVKQDFAPARLGDARNQLEDGGFARTGVSRDKYHFAFVDLEADVFQGFKTAGIGFGNLFETDHRRSCKEGRHIVSGGCVRRDMPSEQ

SEQ ID NO: 7757 - DNA, 351 bp, Neisseria gonorrhoeae
atggataaacatacaacccgactccgtcgtgcacgcaaaacccgtgctcgtattgcggacttgaaaatggtaagattatgtgtgttccgaagcaataatcatatttatgctcaagtaattagtgctgaaggtgataaagtattggctcaagcctctacattggaagctgaggtgcgcggtagtctgaaatctggaagcaatgttgaagcagctgcaatagttggtaaacgtattgctgagaaggctaaagcagcaggtgtagaaaaggttgcttttgatcgttcaggtttccaatatcacggtcgtgtgaaggctttggctgaagctgctcgtgaaaatggtttaagcttc

SEQ ID NO: 7758 - protein, 117 aa, Neisseria gonorrhoeae
MDKHTTRLRRARKTRARIADLKMVRLCVFRSNNHIYAQVISAEGDKVLAQASTLEAEVRGSLKSGSNVEAAAIVGKRIAEKAKAAGVEKVAFDRSGFQYHGRVKALAEAARENGLSF

SEQ ID NO: 7759 - DNA, 954 bp, Neisseria gonorrhoeae
gtgagtggagcagaaagttaccggcatatcacggtcttgctgaatgaggcggtggatgcgcttgccgtgcgcgaagacggtgtctatgtggacggtacgttcggcaggggagggcattcccggctgattttgtcgcgtttgggcgatgcggggcggttgattgttttcgacaaagacccgcaggcgattgctgtggcagaagagctggcgcgttcggacaaacgggtcggtgtcgtgcatggcggttttgcttcgtttcagacggcattggacggtttgggtatcggcaaggtggacggtgcgctgtttgatttggggatttcgtctccgcaaatcgatgacggcagccgcggtttcagcttccgtttcgatgcccctttggatatgcgtatggatacgacgcgcggtatgtctgccgcagagtggatagcggttgcgtcggaacaggatttgcacgaggtaatcaagaattatggtgaagagcggtttagccgccagattgtgcgcgccattgtcgcgcaacgggcggaaagtccaatcgatacaacccgcaagctggcgcagatcgtggcacaaaacgtccgtactcgcgagcgggggcaggatcctgcgacgcgcaccttccaggcaatccgcatctttattaaccgcgagcttgaagaagtaggggcggtattgccgcaggtcatgtgccgtctgaaagagggcgggcgtttggcggtcattgctttccattcgttggaagaccgcattgtgaagcagtttgtcaaaaaatattcgcaacacgagcccctgccgagctgggcggcggtcagagaagcggatttgcccgatccgcccctgaaaatcgtgggcagggcattaaagccgggtgaagcggaaattgccgccaacccgagggcgaggagcgcagttttgcgtgtggcggagcggactgccggtccgataccggaa

SEQ ID NO: 7760 - protein, 318 aa, Neisseria gonorrhoeae
VSGAESYRHITVLLNEAVDALAVREDGVYVDGTFGRGGHSRLILSRLGDAGRLIVFDKDPQAIAVAEELARSDKRVGVVHGGFASFQTALDGLGIGKVDGALFDLGISSPQIDDGSRGFSFRFDAPLDMRMDTTRGMSAAEWIAVASEQDLHEVIKNYGEERFSRQIVRAIVAQRAESPIDTTRKLAQIVAQNVRTRERGQDPATRTFQAIRIFINRELEEVGAVLPQVMCRLKEGGRLAVIAFHSLEDRIVKQFVKKYSQHEPLPSWAAVREADLPDPPLKIVGRALKPGEAEIAANPRARSAVLRVAERTAGPIPE

SEQ ID NO: 7761 - DNA, 531 bp, Neisseria gonorrhoeae
atgtcacgtgtcgcaaaaaacccagtgacggttcccgctggtgtagaagtaaaatttggaacagaggcattggttattaagggtaagaacggtgaattgtcttttcctttgcattctgatgtagccattgaatttaatgatggcaaattgacttttgttgcgaataatagcagtaaacaagcaaatgcaatgtctggtactgctcgcgcattagtcagcaatatggttaaaggtgtttcagaaggttttgagaagaaattacaattgatgggcgtgggttatcgtgctcaagcacaaggtaaaatcttgaatctgtctttgggtttttctcatccgatcgtatatgaaatgcctgaaggtgtctccgttcaaactcctagccaaacagagattgttttaactggctcggataaacaagttgttggtcaagttgcttctgagattcgtgcgttccgtgctcctgagccttataaaggtaaaggtgttcgctatgtaggcgaagtagtggtaatgaaagaagccaagaaaaaa

SEQ ID NO: 7762 - protein, 177 aa, Neisseria gonorrhoeae
MSRVAKNPVTVPAGVEVKFGTEALVIKGKNGELSFPLHSDVAIEFNDGKLTFVANNSSKQANAMSGTARALVSNMVKGVSEGFEKKLQLMGVGYRAQAQGKILNLSLGFSHPIVYEMPEGVSVQTPSQTEIVLTGSDKQVVGQVASEIRAFRAPEPYKGKGVRYVGEVVVMKEAKKK

SEQ ID NO: 7763 - DNA, 465 bp, Neisseria gonorrhoeae
ttggggcatgtcatgttcggcggcgcacacgaattaagcatcgacagtaaggggcggttggctgttcctgccaaattccgcgacattctgtcgcgcctctatacgcctgccgtagtggcaacgctcgagtcgaaacataagctgttgatgtaccctgttgcggagtgggaaaaggttgcggcgcaacttttaaacttaaaagtggcggataaccctgttttgcggcggtttcaaaatcttttgctgcataacgcggaaattttggaatgggacagcgccggcagggtgctggttcctgccggactgaggaaaagggtggatttcgaccgtgaagttgttttggtcggccgtgccaaccgtttggagctttggggtcgcgagcagtgggaggctgagatggttcaggctttggatgacgatcctgacgaacttgccttccagttgagtcagacggatttgcaattg

SEQ ID NO: 7764 - protein, 155 aa, Neisseria gonorrhoeae
LGHVMFGGAHELSIDSKGRLAVPAKFRDILSRLYTPAVVATLESKHKLLMYPVAEWEKVAAQLLNLKVADNPVLRRFQNLLLHNAEILEWDSAGRVLVPAGLRKRVDFDREVVLVGRANRLELWGREQWEAEMVQALDDDPDELAFQLSQTDLQL

SEQ ID NO: 7765 - DNA, 390 bp, Neisseria gonorrhoeae
atgagtatgcatgatcctatttccgatatgttgactcgtatccgcaatgcgcaacgtgctaataaagcagcagttgcaatgccttcttcaaaattaaagtgtgctattgcaaaggtattgaaagaagaaggatatattgaggacttcgcagtttcatctgacgtaaagtctatattggaaattcaattaaaatactatgcaggtcgtcctgtaattgaacaaatcaagcgtgtatctcgccccggtttgcgtatttataaagcgtctagtgagattccaagtgttatgaatggcttgggtattgctatcgttagtacttctaaaggtgtaatgactgatcgtaaagcacgttctcaaggtgttggtggtgagttgttatgcattgtagcc

SEQ ID NO: 7766 - protein, 130 aa, Neisseria gonorrhoeae
MSMHDPISDMLTRIRNAQRANKAAVAMPSSKLKCAIAKVLKEEGYIEDFAVSSDVKSILEIQLKYYAGRPVIEQIKRVSRPGLRIYKASSEIPSVMNGLGIAIVSTSKGVMTDRKARSQGVGGELLCIVA

SEQ ID NO: 7767 - DNA, 303 bp, Neisseria gonorrhoeae
atggctaagaaagcacttattaatcgtgatctgaaacgtcaagctttggctaaaaaatatgcggctaaacgcgcggcaattaaagcggtaatcaatgattcgaatgcaactgaggaagagcgttttgaggctcgtttgaggtttcaatccattcctcgtaatgcggcacctgtgcgtcaacgtcgtcgttgtgctttgacaggtcgccctcgtggtactttccgtaaatttggtttgggtcgtattaaaatccgtgaaatcgccatgcgtggcgaaattccgggtgttgttaaagccagctgg

SEQ ID NO: 7768 - protein, 101 aa, Neisseria gonorrhoeae
MAKKALINRDLKRQALAKKYAAKRAAIKAVINDSNATEEERFEARLRFQSIPRNAAPVRQRRRCALTGRPRGTFRKFGLGRIKIREIAMRGEIPGVVKASW

SEQ ID NO: 7769 - DNA, 195 bp, Neisseria gonorrhoeae
ttgtttattggttcggtcactctgtactgcacccgccgtgccgttgtcgtcattttttatcttattgtttttaaacagaataaaaatttcagatatgttaatgagttttcatgccctgatttgaccgagtgtttaaaatttcttatagtgtcgattggtggggaattgtggggcaaagtgtctcttttacccttg

SEQ ID NO: 7770 - protein, 65 aa, Neisseria gonorrhoeae
LFIGSVTLYCTRRAVVVIFYLIVFKQNKNFRYVNEFSCPDLTECLKFLIVSIGGELWGKVSLLPL

SEQ ID NO: 7771 - DNA, 537 bp, Neisseria gonorrhoeae
atggctcggttgagagagttttataaagagacagttgttcctgaattggttaaacaatttggttacaaatcagtaatggaagtcccgcgtattgaaaaaatcaccttgaatatgggtgtgggtgaggctgttgctgacaaaaaagttatggaacatgctgtttccgatttagagagaattgccggtcaaagaccggttgttactgttgcccgtaaatctatcgcaggttttaaaatccgtgataactatccggttggttgcaaagtaacattgcgtcgtgatcaaatgtttgaattcttggatcgtttgattactattgcattacctcgcgtacgtgacttccgtggtgtgagcggtaaatcatttgatggtcgtggcaattacaatatgggtgttcgtgagcaaattattttcccggaaattgaatacgataaaattgatgctttgcgtggtttgaatattactattactactacagcaaaaaccgatgaggaagcgaaagctttattgtcattgtttaaatttccgttcaaagga

SEQ ID NO: 7772 - protein, 179 aa, Neisseria gonorrhoeae
MARLREFYKETVVPELVKQFGYKSVMEVPRIEKITLNMGVGEAVADKKVMEHAVSDLERIAGQRPVVTVARKSIAGFKIRDNYPVGCKVTLRRDQMFEFLDRLITIALPRVRDFRGVSGKSFDGRGNYNMGVREQIIFPEIEYDKIDALRGLNITITTTAKTDEEAKALLSLFKFPFKG

SEQ ID NO: 7773 - DNA, 1245 bp, Neisseria gonorrhoeae
atgacagcacccgtaccaacgtgtaatatgtcgggaaatccaataaatttacacaagctaacatttatcatgctcctcccctcccccgaagcacggcaatcctcgctcaatctgcaaaccctcattgccgaagaaatcggcaaacacggcaattggattccattttcacgttttatggaattggttttatacgctccgcaatacggctactacaccggcggcagccataaaatcggcaataccggggattttattaccgcaccgaccctcacccctctgtttgcacagacactggcacgccaacttcaagaactcctgccccaaacggcgggcaatatctatgaattcggcgcgggaaccggacagcttgccgccgatttgttgggcagcgtttcagacagcatcaactgttactatattattgaaatatcgccggagctggcagcacgtcagaaaaacctgattcaagcccgtgcaccggaagcatctcaaaaagttgtccacttgaccgcacttcccgaagcgtttgacggcatcatcatcggcaacgaattactcgatgccatacctgtcgaaatcgtccgtaaaaatgaaggaggattactcgagcacatcggcgtttgcacggataacggccgtttcgcctattctgcaagacccttgcacgacccgtcgctttccacctcggcttccctctattttcctcaaacagattatccctataccagcgaactgcacccgcaacaatatgcctttatccgcacccttgcctcaaggcttgaacgcgggggtatgatattcatcgactacggttttgatgcggcgcagtattaccacccgcaacgcaatcaaggcacattgatcggacactaccgacaccacgttatccacaatcctttcgacttcatcgggttggcagatctgaccgcccacgtcaactttaccgacattgcccaagccggtacggatgcaggactggatttgacaggctatctgccccagtcccattttctgctgaatctgggcataaccgaactgttggcacagacgggtaaaacagattcggcagcctatatccgtgaagccgccgctgttcaaaaactgattgaccagcatgaaatgggcgaactgtttaaagtcatcgcattcggaaaaaatatcggcatcgactgggcaggattccgcttcggcgacatctgccacaaactccaaccctcgtgccgtctgaatccgcttcagacggca

SEQ ID NO: 7774 - protein, 415 aa, Neisseria gonorrhoeae
MTAPVPTCNMSGNPINLHKLTFIMLLPSPEARQSSLNLQTLIAEEIGKHGNWIPFSRFMELVLYAPQYGYYTGGSHKIGNTGDFITAPTLTPLFAQTLARQLQELLPQTAGNIYEFGAGTGQLAADLLGSVSDSINCYYIIEISPELAARQKNLIQARAPEASQKVVHLTALPEAFDGIIIGNELLDAIPVEIVRKNEGGLLEHIGVCTDNGRFAYSARPLHDPSLSTSASLYFPQTDYPYTSELHPQQYAFIRTLASRLERGGMIFIDYGFDAAQYYHPQRNQGTLIGHYRHHVIHNPFDFIGLADLTAHVNFTDIAQAGTDAGLDLTGYLPQSHFLLNLGITELLAQTGKTDSAAYIREAAAVQKLIDQHEMGELFKVIAFGKNIGIDWAGFRFGDICHKLQPSCRLNPLQTA

SEQ ID NO: 7775 - DNA, 177 bp, Neisseria gonorrhoeae
atgcgtggcattaagggcggtattattactaaagaaatgcctttggatatttctaatatcgcaatcctgaatccggaaactaataaagcggaccgtgttggtattaagctgattgaaaatgaaggcaaagttaaacgcgttcgtttcttcaaatcaaatggctctatcattggagca

SEQ ID NO: 7776 - protein, 59 aa, Neisseria gonorrhoeae
MRGIKGGIITKEMPLDISNIAILNPETNKADRVGIKLIENEGKVKRVRFFKSNGSIIGA

SEQ ID NO: 7777 - DNA, 417 bp, Neisseria gonorrhoeae; identical to SEQ ID NO: 6733

SEQ ID NO: 7778 - protein, 139 aa, Neisseria gonorrhoeae; identical to SEQ ID NO: 6734

SEQ ID NO: 7779 - DNA, 216 bp, Neisseria gonorrhoeae
ttgcctgttttgaaggcagtggtttattctttattttccggcaatcaggcaataaaaaagcacataccttttacggtctgtgcttttttatctggtggaggtaagcgggatcgaaccgctgacctcttgcatgccatgcaagcgctctaccaactgagctatacccccgaaaatctggtagcgaatcagggactcgaaccccggacacaaggatta

SEQ ID NO: 7780 - protein, 72 aa, Neisseria gonorrhoeae
LPVLKAVVYSLFSGNQAIKKHIPFTVCAFLSGGGKRDRTADLLHAMQALYQLSYTPENLVANQGLEPRTQGL

SEQ ID NO: 7781 - DNA, 366 bp, Neisseria gonorrhoeae
atgattcaaatgcagaccatcttagatgtggctgataactctggtgcgcgtcgcgtaatgtgtatcaaggtattgggcggatctaagcgtcgctacgcttctgttggcgatattattaaagtggcagttaaagatgcggttccgcgtggccgtgtcaaaaaaggcgatgtatataatgcggtagttgttcgtactgctaagggtgtgcgtcgtcctgatggtgcgttaattaaattcgataacaatgccgccgtgttgctgaataataaacttgaacctttgggtactcgtatctttggtccggtaacccgtgaattgcgtactgagcgatttatgaaaatcgtttcattggcacctgaagtatta

SEQ ID NO: 7782 - protein, 122 aa, Neisseria gonorrhoeae
MIQMQTILDVADNSGARRVMCIKVLGGSKRRYASVGDIIKVAVKDAVPRGRVKKGDVYNAVVVRTAKGVRRPDGALIKFDNNAAVLLNNKLEPLGTRIFGPVTRELRTERFMKIVSLAPEVL

SEQ ID NO: 7783 - DNA, 858 bp, Neisseria gonorrhoeae; identical to SEQ ID NO: 4139

SEQ ID NO: 7784 - protein, 286 aa, Neisseria gonorrhoeae; identical to SEQ ID NO: 4140

SEQ ID NO: 7785 - DNA, 93 bp, Neisseria gonorrhoeae
atgcaaaacactaaaaatcaagcacgcagctcaggcattcatgcccaacacaatccgacaaatgacaaaccactttcagacaacctcgttttt

SEQ ID NO: 7786 - protein, 31 aa, Neisseria gonorrhoeae
MQNTKNQARSSGIHAQHNPTNDKPLSDNLVF

SEQ ID NO: 7787 - DNA, 270 bp, Neisseria gonorrhoeae
gtgaacaattcagtcatcaccgtcatcggtaaagaccgcgtcggcatcgtgtacgatgtttccaaaattttggcggaaaaccgaatcaacatcctcaatatcagccaacagctgatggacgatttttttactatgattatcttggtggatacctcgaaatgccctaaatcgcggcaggagattttggatttgtttgcggaagagagcaaaaaactcgcgcttgacatccgtatgcaaaacgaagaaatcttccaagcgatgcaccgcatt

SEQ ID NO: 7788 - protein, 90 aa, Neisseria gonorrhoeae
VNNSVITVIGKDRVGIVYDVSKILAENRINILNISQQLMDDFFTMIILVDTSKCPKSRQEILDLFAEESKKLALDIRMQNEEIFQAMHRI

SEQ ID NO: 7789 - DNA, 261 bp, Neisseria gonorrhoeae
atgagcgaaactaaaaatgttcgtactttgcaaggcaaagtagtaagcgacaaaatggataaaaccgtaacagtattggttgagcgtaaagtaaaacattcgctgtatggtaagattattcgattatctactaaaatccatgcccatgatgaaaataatcaatatggaattggtgatgtggttgttatatcggaatcccgtccattgtcaaaaactaaatcttgggttgtcagtgagttggttgagaaagcacgttctatt

SEQ ID NO: 7790 - protein, 87 aa, Neisseria gonorrhoeae
MSETKNVRTLQGKVVSDKMDKTVTVLVERKVKHSLYGKIIRLSTKIHAHDENNQYGIGDVVVISESRPLSKTKSWVVSELVEKARSI

SEQ ID NO: 7791 - DNA, 819 bp, Neisseria gonorrhoeae
atggattttttgattgtcctgaaagccctgatgatgggcttggtagaaggttttaccgaatttttaccgatttccagcaccggacatttgattgtgttcggcaatctgattggttttcacagcaatcacaaggtttttgaaattgccatccagctcggtgcggttttggcggtagtgtttgaataccggcagcgtttcagcaatgtgttgcatggcgtgggaaaagaccggaaagccaaccgtttcgtcctcaatcttgccattgcttttatacctgccgccgtgatggggctgttgttcgacaaacaaatcaaagagtatctgtttaaccccttgagtgttgcagtcatgctggttttgggcggtttttttattttgtgggtggagaaacgccaaagccgagcagagcctaaaattgccgatgttgatgcattgcgtccgattgatgcgttgatgatcggtgttgcccaagtgtttgcactggttccgggtacgtcccgttcgggcagtacggttatgggcgggatgctttggggaatcgagcggaaaacggcaacggagttttcatttttcttggccgttccgatgatggttgcagcaacggcttatgatgtcctgaaacattaccgatttttcaccctgcatgatgtcggtttgattttgataggctttattgccgcttttgtttccggtttggtagcggttaaagcactgctgaagtttgtttccaagaaaaactatatcccgtttgcctattaccgcattgttttcggcattgtcatcataatattgtggttgtcgggctggataagttgggaa

SEQ ID NO: 7792 - protein, 273 aa, Neisseria gonorrhoeae
MDFLIVLKALMMGLVEGFTEFLPISSTGHLIVFGNLIGFHSNHKVFEIAIQLGAVLAVVFEYRQRFSNVLHGVGKDRKANRFVLNLAIAFIPAAVMGLLFDKQIKEYLFNPLSVAVMLVLGGFFILWVEKRQSRAEPKIADVDALRPIDALMIGVAQVFALVPGTSRSGSTVMGGMLWGIERKTATEFSFFLAVPMMVAATAYDVLKHYRFFTLHDVGLILIGFIAAFVSGLVAVKALLKFVSKKNYIPFAYYRIVFGIVIIILWLSGWISWE

SEQ ID NO: 7793 - DNA, 189 bp, Neisseria gonorrhoeae
atgaaagcaaatgaattgaaagacaaatccgttgagcagttgaatgcagatttgttggacttgttgaaagctcagtttggcttacgtatgcaaaacgctaccggtcaattaggcaaaccaagtgaattgaaacgtgtacgtcgcgatattgctcgtattaaaaccgttttaactgaaaaaggtgctaag

SEQ ID NO: 7794 - protein, 63 aa, Neisseria gonorrhoeae
MKANELKDKSVEQLNADLLDLLKAQFGLRMQNATGQLGKPSELKRVRRDIARIKTVLTEKGAK

SEQ ID NO: 7795 - DNA, 642 bp, Neisseria gonorrhoeae
atgaagtttaaacatctgttgccgctgctgctgtcggcagtgttgtccgcgcaggcatatgccctgacggaaggggaagactatcttgtgttggataaacccattcctcaagaacagccgggaaaaattgaggttttggaatttttcggctatttttgcgtacattgccatcatttcgatcctttgttattgaaactgggcaaggcattgccgtctgatacttatctgcggacggagcacgtggtctggcggcctgaaatgctcggtctggcaagaatggctgctgcggtcaagctgtcgggtttgaaatatcaggcaaactctgctgtgtttaaagcagtttacgaacaaaaaatccgtttggaaaacagggctgttgccgggaaatgggctttatctcaaaaaggttttgacggcaaaaaactgatgcgcgcctatgattcccccgaagctgccgccgtcgcattaaaaatgcagaaactgacggaacaatacggtattgacagcacgccgaccgttattgtcggcggaaaataccgcgttatcttcaataatggctttgatggcggcgttcatacgattaaagaattggttgccaaagtcagggaagaacgcaagcgtcagacccctgctgtacagaaa

SEQ ID NO: 7796 - protein, 214 aa, Neisseria gonorrhoeae
MKFKHLLPLLLSAVLSAQAYALTEGEDYLVLDKPIPQEQPGKIEVLEFFGYFCVHCHHFDPLLLKLGKALPSDTYLRTEHVVWRPEMLGLARMAAAVKLSGLKYQANSAVFKAVYEQKIRLENRAVAGKWALSQKGFDGKKLMRAYDSPEAAAVALKMQKLTEQYGIDSTPTVIVGGKYRVIFNNGFDGGVHTIKELVAKVREERKRQTPAVQK

SEQ ID NO: 7797 - DNA, 414 bp, Neisseria gonorrhoeae
atgctgcagccaactagactgaaataccgtaagcaacaaaagggtcgcaataccggcatcgctactcgcggtaataaggtaagtttcggtgagttcggcttgaaagccgtaggtcgtggtcgtttgactgcccgtcaaatcgaagctgctcgtcgtgcaatgacccgtcacatcaaacgtggtggtcgtatttggattcgtgtattccctgacaaaccgattactgaaaagcctattcaagttcgtatgggtggcggtaaaggtaacgtggaatattacattgccgaaattaaaccaggtaaagtgttgtatgaaatggatggcgttccagaggaactggctcgtgaagcattcgagttggctgctgccaaattgcctattcctacaacctttgtagtaagacaggtgggtcaa

SEQ ID NO: 7798 - protein, 138 aa, Neisseria gonorrhoeae
MLQPTRLKYRKQQKGRNTGIATRGNKVSFGEFGLKAVGRGRLTARQIEAARRAMTRHIKRGGRIWIRVFPDKPITEKPIQVRMGGGKGNVEYYIAEIKPGKVLYEMDGVPEELAREAFELAAAKLPIPTTFVVRQVGQ

SEQ ID NO: 7799 - DNA, 690 bp, Neisseria gonorrhoeae
atgggacaaaagattaaccctacaggctttcgcctggcggtaactaaagactgggcttcaaaatggtttgctaaaagtaccgacttttctactgttttgaagcaggatatcgatgttcgcaattatttgcgtcaaaaattggccaatgcttcggttggtcgagtaattattgaacgccctgcaaaatctgcacgcattaccattcactccgctcgtccgggtgtggttatcggtaaaaaaggtgaggatatcgaagttttgaaacgtgacttgcaagtcttgatgggtgtacctattcatgtaaatattgaagagattcgccgtcctgagttggatgctcaaattattgctgacggtatcgcccagcagttggaaaaacgcgttcaattccgtcgtgctatgaaacgagcaatgcaaaatgcaatgcgttctggtgctaaaggcattaagattatgacttcaggccgtctgaatggtgcggatattgcccgtagcgaatggtatcgtgaaggtcgcgtgccactgcatactttacgtgcaaatgtagattatgcaaccagcgaagcgcacaccacatatggtgtattgggtctgaaagtttgggtttatacggaaggcaatattaaatcttccaaacctgaacatgagagtaaacaaagaaaggcaggtagacgtaatgctgcagccaac

SEQ ID NO: 7800 - protein, 230 aa, Neisseria gonorrhoeae
MGQKINPTGFRLAVTKDWASKWFAKSTDFSTVLKQDIDVRNYLRQKLANASVGRVIIERPAKSARITIHSARPGVVIGKKGEDIEVLKRDLQVLMGVPIHVNIEEIRRPELDAQIIADGIAQQLEKRVQFRRAMKRAMQNAMRSGAKGIKIMTSGRLNGADIARSEWYREGRVPLHTLRANVDYATSEAHTTYGVLGLKVWVYTEGNIKSSKPEHESKQRKAGRRNAAAN

SEQ ID NO: 7801 - DNA, 867 bp, Neisseria gonorrhoeae
atgtttatgaacaaattttcccaatccggaaaaggtctgtccggtttcttcttcggtttgatactggcaacggtcattattgccggtattttgctttatctgaaccagggcggtcaaaatgcgttcaaaatcccggctccgtcgaagcagcctgcagaaacggaaatcctgaaactgaaaaaccagcctaaggaagacatccaacctgaaccggccgatcaaaacgccttgtccgaaccggatgttgcgaaagaggcagagcagtcggatgcggaaaaagctgccgacaagcagcccgttgccgacaaagccgacgaggttgaagaaaaggcgggcgagccggaacgggaagagccggacggacaggcagtgcgcaagaaagcactgacggaagagcgtgaacaaaccgtcagggaaaaagcgcagaagaaagatgccgaaacggttaaaaaacaagcggtaaaaccgtctaaagaaacagagaaaaaagcttcaaaagaagagaaaaaggcggcgaaggaaaaagttgcacccaaaccgaccccggaacaaatcctcaacagcggcagcatcgaaaaagcgcgcagtgccgctgccaaagaagtgcagaaaatgaaaacgtttggcaaggcggaagcaacgcattatctgcaaatgggcgcgtatgccgaccgccggagcgcggaagggcagcgtgccaaactggcaatcttgggcatatcttccgaagtggtcggctatcaggcgggacataaaacgctttaccgcgtgcaaagcggcaatatgtctgccgatgcggtgaaaaaaatgcaggacgagttgaaaaagcatggggttgccagcctgatccgtgcgattgaaggcaaa

SEQ ID NO: 7802 - protein, 289 aa, Neisseria gonorrhoeae
MFMNKFSQSGKGLSGFFFGLILATVIIAGILLYLNQGGQNAFKIPAPSKQPAETEILKLKNQPKEDIQPEPADQNALSEPDVAKEAEQSDAEKAADKQPVADKADEVEEKAGEPEREEPDGQAVRKKALTEEREQTVREKAQKKDAETVKKQAVKPSKETEKKASKEEKKAAKEKVAPKPTPEQILNSGSIEKARSAAAKEVQKMKTFGKAEATHYLQMGAYADRRSAEGQRAKLAILGISSEVVGYQAGHKTLYRVQSGNMSADAVKKMQDELKKHGVASLIRAIEGK

SEQ ID NO: 7803 - DNA, 327 bp, Neisseria gonorrhoeae
atgagagtaaatgcacaacataaaaatgcccgtatctctgctcaaaaggctcgtttggtagctgatttgattcgtggtaaagacgttgcccaagctttgaatattttggctttcagccctaaaaaaggtgccgagctgatcaaaaaagtattggagtcagctattgctaatgctgagcataataacggtgcggacattgatgaactgaaagtggtaactatctttgttgacaaaggtccaagcttgaaacgttttcaagctcgcgccaaaggtcgcggtaaccgcatcgaaaaacaaacttgtcatatcaatgtgacagtgggtaac

SEQ ID NO: 7804 - protein, 109 aa, Neisseria gonorrhoeae
MRVNAQHKNARISAQKARLVADLIRGKDVAQALNILAFSPKKGAELIKKVLESAIANAEHNNGADIDELKVVTIFVDKGPSLKRFQARAKGRGNRIEKQTCHINVTVGN

SEQ ID NO: 7805 - DNA, 276 bp, Neisseria gonorrhoeae
atggctcgttcattgaaaaaaggcccatatgtagacctgcatttgctgaaaaaagtagatgctgttcgcgcaagcaacgacaaacgcccgattaaaacctggtctcgtcgttctaccattctgcctgattttatcggtctgaccattgccgtgcacaacggtcgcacccatgtgcctgtgtttatcagcgacaatatggttggtcataaattaggcgaattctcattgacccgtacctttaaaggccacctggccgataaaaaggctaaaaagaaa

SEQ ID NO: 7806 - protein, 92 aa, Neisseria gonorrhoeae
MARSLKKGPYVDLHLLKKVDAVRASNDKRPIKTWSRRSTILPDFIGLTIAVHNGRTHVPVFISDNMVGHKLGEFSLTRTFKGHLADKKAKKK

SEQ ID NO: 7807 - DNA, 831 bp, Neisseria gonorrhoeae
atggcaatcgttaaaatgaagccgacctctgcaggccgtcgcggcatggttcgcgtggtaacagaaggtttgcacaaaggtgcaccttatgcacccttgcttgaaaagaaaaattctactgccggccgtaacaataatggtcatatcaccacccgtcacaaaggcggcggtcataaacaccattaccgtgttgtagactttaaacgtaacaaagacggcatttctgctaaagtagagcgtatcgaatacgatcctaaccgtactgccttcatcgcactgttgtgctatgcagacggcgagcgtcgttacatcatcgctcctcgcggtattcaagccggtgtcgtattggtttccggtgctgaagctgccatcaaagtaggcaacaccctgccgatccgcaacattcccgttggtacgactatccactgtatcgaaatgaaacccggtaaaggtgctcaaatcgcacgttctgccggtgcttctgcggtattgttggctaaagaaggtgcatacgctcaagtccgtctgcgctctggcgaagttcgtaaaatcaacgtagattgccgtgcgaccatcggtgaagtcggtaacgaagagcaaagcctgaaaaaaatcggtaaagccggtgctaaccgttggcgcggtattcgtccgaccgtacgcggtgttgtcatgaatcccgtcgatcacccgcatggtggtggtgaaggccgtaccggcgaagcccgcgaaccggttagtccatggggtactcctgctaaaggctaccgcactcgtaataacaaacgcacggataatatgattgttcgtcgccgttactcaaataaaggt

SEQ ID NO: 7808 - protein, 277 aa, Neisseria gonorrhoeae
MAIVKMKPTSAGRRGMVRVVTEGLHKGAPYAPLLEKKNSTAGRNNNGHITTRHKGGGHKHHYRVVDFKRNKDGISAKVERIEYDPNRTAFIALLCYADGERRYIIAPRGIQAGVVLVSGAEAAIKVGNTLPIRNIPVGTTIHCIEMKPGKGAQIARSAGASAVLLAKEGAYAQVRLRSGEVRKINVDCRATIGEVGNEEQSLKKIGKAGANRWRGIRPTVRGVVMNPVDHPHGGGEGRTGEAREPVSPWGTPAKGYRTRNNKRTDNMIVRRRYSNKG

SEQ ID NO: 7809 - DNA, 1494 bp, Neisseria gonorrhoeae
atgtcgcttgccttggtttacagccgcgccttgagcggtatgaatgcgccgttggtcgaagtggaagcccaccttgccaacggcctgccgcatttcaacatcgtcggactgcccgatacggaagtaaaggaaagccgcgaccgcgtccgtgccgccattattcaaagcggttttgaattccccgccaaaaaaatcaccgtcaacctcgcccctgccgacctgcccaaagagtcggggcgtttcgatttgccgattgcaatcggcatccttgccgcatcggggcaggttgcacccgaaaagctggcggaatacgagtttgcgggggaattggcactgtcggggttgttgcgccccgtgcgcggcgcgttggcgatggcgtggcagggtatgcaggcaaaacgtgcatttgttttgcctgaagaaaacgcaggacaagccgccgtgatgcgcggcattaccgtttacggcgcgcgctctttgggcgaagtcgccgctcatttgaacggtatcgaacctttggcgcaaaccgaatgttccgtaccgcaaatgccgtctgaacatggcggacaacctgatttgtgtgatgtgaaaggtcagcactctgcccgccttgctttggaaatcgccgccgcaggcggacacagcctcttgatgatgggcccgccgggaacaggcaagtctatgctctcccaacggctgcccggcatcctgccgccgctggccgaagacgaattggtagaagtttgggcattgcgttcgctcctgcccaaccaccaacaacaactcgacagcaaccgtcctttccgcagtccgcatcacggcgccagcgcggcggctatggtcggcggcggctcggatccgcgtccgggcgagatttcattggcgcatcacggcgttttatttttggacgaattgcccgagttcgaccgcaaagttttggaggttttgcgcgaaccgttggaaaacggcgaaatccacatttcccgcgcggcgcgccaagccgtctatcccgccaaattccagcttgtcgctgccatgaacccgtgtccgtgcggttatctcgggcatcccgtcaaaccctgccgctgcacgcccgaaagtgtcgcgcgttaccgaagcaaaatttccggtccgctgctcgaccgcatcgatttgaccatcgaagtccccagcctgtccgccgccgaactgatgcagcaggaagcgggcgaaagcagtgcgtccgttttggaacgcgtcatcgccgcccgcggcaaacaatacgcacggcagggcaaagtcaacgccgctttgagcgtcagcgaactcgattcccaagcctgcatccaaaaagaagcgcaggaagccttgggtagcctgctggaaaaattgtctctttccgcccgcagcttccaccgcattatgcgcgtggcgcgtacattggcggatttggcgggcgatgaagaagtcggcagaagccacgtcatgaaagccataggcttccgtcgtgcttta

SEQ ID NO: 7810 - protein, 498 aa, Neisseria gonorrhoeae
MSLALVYSRALSGMNAPLVEVEAHLANGLPHFNIVGLPDTEVKESRDRVRAAIIQSGFEFPAKKITVNLAPADLPKESGRFDLPIAIGILAASGQVAPEKLAEYEFAGELALSGLLRPVRGALAMAWQGMQAKRAFVLPEENAGQAAVMRGITVYGARSLGEVAAHLNGIEPLAQTECSVPQMPSEHGGQPDLCDVKGQHSARLALEIAAAGGHSLLMMGPPGTGKSMLSQRLPGILPPLAEDELVEVWALRSLLPNHQQQLDSNRPFRSPHHGASAAAMVGGGSDPRPGEISLAHHGVLFLDELPEFDRKVLEVLREPLENGEIHISRAARQAVYPAKFQLVAAMNPCPCGYLGHPVKPCRCTPESVARYRSKISGPLLDRIDLTIEVPSLSAAELMQQEAGESSASVLERVIAARGKQYARQGKVNAALSVSELDSQACIQKEAQEALGSLLEKLSLSARSFHRIMRVARTLADLAGDEEVGRSHVMKAIGFRRAL

SEQ ID NO: 7811 - DNA, 228 bp, Neisseria gonorrhoeae
atgacgtttaaagtcttggcaaatgcaaccaaacctgaaatcaaagctgctgtcgagctgctgttcggtgttcaagttgcttctgtaactaccgttaccactaaaggcaaaactaagcgttttggtcgtattttgggtcgccgcagcgatgttaaaaaagcttatgtaagcttggttgacggtcaagagttggatttggaagccgctgctgcagctgcagataaggaa

SEQ ID NO: 7812 - protein, 76 aa, Neisseria gonorrhoeae
MTFKVLANATKPEIKAAVELLFGVQVASVTTVTTKGKTKRFGRILGRRSDVKKAYVSLVDGQELDLEAAAAAADKE

SEQ ID NO: 7813 - DNA, 324 bp, Neisseria gonorrhoeae
ttggatactcatcacattcctccgactcaaatgcggtgcatcgcttggaagatttcttcgttttgcatacggatgtcaagcgcgagttttttgctctcttccgcaaacaaatccaaaatctcctgccgcgatttagggcatttcgaggtatccaccaagataatcatagtaaaaaaatcgtccatcagctgttggctgatattgaggatgttgattcggttttccgccaaaattttggaaacatcgtacacgatgccgacgcggtctttaccgatgacggtgatgactgaattgttcacaggcttactccttgcagatatccgt

SEQ ID NO: 7814 - protein, 108 aa, Neisseria gonorrhoeae
LDTHHIPPTQMRCIAWKISSFCIRMSSASFLLSSANKSKISCRDLGHFEVSTKIIIVKKSSISCWLILRMLIRFSAKILETSYTMPTRSLPMTVMTELFTGLLLADIR

SEQ ID NO: 7815 - DNA, 135 bp, Neisseria gonorrhoeae
ttggggctcggcaacggtattcttcagcagctatctgtttacagattgtttttcaaaaaacgaggttgtctgaaagtggtttgtcatttgtcggattgtgttgggcatgaatgcctgagctgcgtgcttgatttt

SEQ ID NO: 7816 - protein, 45 aa, Neisseria gonorrhoeae
LGLGNGILQQLSVYRLFFKKRGCLKVVCHLSDCVGHECLSCVLDF

SEQ ID NO: 7817 - DNA, 654 bp, Neisseria gonorrhoeae
atgaaactatatgaaattgtaaataatccgtttcagcataacccaatttctgttgtttgcaaagcacttaaatggcttaaaaagccgagtttgaaacgatgcgcatcggaaaaatcatttaaaacagcatattgttttgtagtgtcttgtaatgtaatcgggcgttgcgcggaatatgaaatccgttttcaggcggcaggtgtctcgaagtgtaattttagcaaccgcaaagggggcgcggtatgttttgacgattatccgccgcccgttttcagacggcatttttccttatacaatagccgcttgaatttgatatgttcaggaaggatgcagattatgttcggcaagcagctttttgaagaagtcggctcgaaaatcagcgaaaccatcgccaacagccctgccaaagatgtggaaaaaaatattaaggcgatgctgggcggcgcgttcaaccgtatggatttggttacgcgcgaagaattcgacatccagcagcaggttttgattaaaacccgtaccaaactggcggctttggaagcacgtctggcgaaactcgaagccgcgcaaaatccccaacgggcagcattggaagcggctgaagccgctgccgaagaagccgtcgccgaaatcaggcagcaaaccgaagccggcgaa

SEQ ID NO: 7818 - protein, 218 aa, Neisseria gonorrhoeae
MKLYEIVNNPFQHNPISVVCKALKWLKKPSLKRCASEKSFKTAYCFVVSCNVIGRCAEYEIRFQAAGVSKCNFSNRKGGAVCFDDYPPPVFRRHFSLYNSRLNLICSGRMQIMFGKQLFEEVGSKISETIANSPAKDVEKNIKAMLGGAFNRMDLVTREEFDIQQQVLIKTRTKLAALEARLAKLEAAQNPQRAALEAAEAAAEEAVAEIRQQTEAGE

SEQ ID NO: 7819 - DNA, 129 bp, Neisseria gonorrhoeae
ttgaagataatttatccgaatcccctttcgggtatccggattttccgttgtactttcattagaaaaacatttcaggcgcaagttgcttgcaatttcaaagcctgtaattctgaagttttagacgaggaa

SEQ ID NO: 7820 - protein, 43 aa, Neisseria gonorrhoeae
LKIIYPNPLSGIRIFRCTFIRKTFQAQVACNFKACNSEVLDEE

SEQ ID NO: 7821 - DNA, 618 bp, Neisseria gonorrhoeae
atggaattgaaagtaattgacgctaaaggacaagtttcaggcagcctgtctgtttctgatgctttgttcgcccgcgaatacaatgaagcgttggttcaccagctggtaaatgcctacttggcaaacgcccgctctggtaaccgtgctcaaaaaacccgtgccgaagtaaaacactcaaccaaaaaaccatggcgtcaaaaaggtaccggccgcgcccgttccggtatgacttcttctccgctgtggcgtaaaggcggtcgcgcgttcccgaacaaacccgacgaaaacttcactcaaaaagtaaaccgtaaaatgtaccgtgccggtatggcgactatcctgtcccaattggcgcgtgacgagcgtttgtttgtgattgaggcgttgactgccgaaactcccaaaaccaaagtttttgccgaacaagtaaaaaatttggctctggagcaagtgctgtttgtaaccaaacggctcgacgagaatgtttacttggcttcacgcaacttgccaaacgtattggttttggaagctcaacaagttgatccttacagcttgctgcgttataaaaaagtaatcatcactaaagatgcggttgcacaattagaggagcaatgggta

SEQ ID NO: 7822 - protein, 206 aa, Neisseria gonorrhoeae
MELKVIDAKGQVSGSLSVSDALFAREYNEALVHQLVNAYLANARSGNRAQKTRAEVKHSTKKPWRQKGTGRARSGMTSSPLWRKGGRAFPNKPDENFTQKVNRKMYRAGMATILSQLARDERLFVIEALTAETPKTKVFAEQVKNLALEQVLFVTKRLDENVYLASRNLPNVLVLEAQQVDPYSLLRYKKVIITKDAVAQLEEQWV

SEQ ID NO: 7823 - DNA, 642 bp, Neisseria gonorrhoeae
atgactttaggtctggttggacgcaaagttggtatgacccgcgtgttcgacgagcagggtgtttctgttccggtaaccgttttggatatgtctgccaaccgcgttacacaagtaaaatccaaagatactgacggctataccgccgttcaagttacctttggtcagaaaaaagccaatcgtgtcaacaaagccgaagccggacactttgcaaaagcaggtgttgaagccggtcgcggtttgattgagtttgctttgactgaagaaaaactggctgaattgaaagccggtgacgaaatcaccgtttctatgtttgaagtcggtcaactggtcgatgtaaccggtacctctaaaggtaaaggtttctccggcacgatcaaacgtcataacttcggtgcccaacgtacttcccacggtaactcccgttctcaccgcgttccaggctctatcggtatggcgcaagacccgggtcgcgtgttccccggtaagcgcatggccggccaatacggcaacaccaaagcaactgttcaaaaattggaagttgtccgtgttgatgcagaacgccaactgctgttggttaagggtgctgttccgggtgcggtcaacagcgatgttgtagttcgtcccagcgtgaaagtaggtgcg

SEQ ID NO: 7824 - protein, 214 aa, Neisseria gonorrhoeae
MTLGLVGRKVGMTRVFDEQGVSVPVTVLDMSANRVTQVKSKDTDGYTAVQVTFGQKKANRVNKAEAGHFAKAGVEAGRGLIEFALTEEKLAELKAGDEITVSMFEVGQLVDVTGTSKGKGFSGTIKRHNFGAQRTSHGNSRSHRVPGSIGMAQDPGRVFPGKRMAGQYGNTKATVQKLEVVRVDAERQLLLVKGAVPGAVNSDVVVRPSVKVGA

SEQ ID NO: 7825 - DNA, 1524 bp, Neisseria gonorrhoeae
atgaatcccatgtacatcacttttgcaatctatttggttgcagtccttctcatcgggcttgccgcttatttttccacgcgcaatttcgatgattatattttgggcgggcgcagcctgggcccgtttgttacggcgatgtcggcaggcgcgtccgatatgtccggctggcttttgatgggtctgccgggcgcgatttatttgagcggtttgaatgaggcttggattgccatcggcctcttggtcggcgcgtatttcaactggctcttggtggcgggccgcctgcgcgtgcataccgaatatgccaacaatgcgctgacgctgccggattatttcttccaccgcttcggcgcgggcggacacttgatgaaagtggtttccgcactgattatcctgtttttcttcacgatttattgcgcctcgggcattgtggcgggcgcaaccctgttccaaagcctgtttgaaggtatgacttacaatcaggcaatgtggctgggcgcgggcgcgaccatcgcctataccttcttgggcggcttcttggcggtcagctggacggatacgctgcaggcttctttgatgattttcgccctgattttaacgccggtgatggtctatctgggcttgggcggcgcggaacagatgtctgccgcgattcaaagcgtcgccgcaggcacgggcaaagaatacggcagcctgtttgccggtacgaccgtcatcggcatcatttccaccgccgcctggggcttgggctatttcggacagccgcacattttggcgcgctttatggccgccgaaagcgcgaaatcgctggtatccgcacgccgcatcggcatgacttggatggcgttgtgccttgcgggcgcggtagcggtcggttatttcggcattgcgtatttcggtgcaaaccccgacaaagtttcttctatgagcggcaaccacgaacgcatcttcatcgcgctttccaccctgctgttcaacccttggatcgccggcatcattttgagcgcgattttggcggcggtgatgtccaccctgtcctgccagcttttggtttgctccagcgcgattaccgaagacttctacaaaggctttttgcgtaaaaacgcgcaacagtcggaattggtatgggtcggccgcctgatggtattggcgattgccgtgatttccatcctgattgcttccgatccgaacagcaaagtattgggactggtgtcttacgcgtgggcaggtttcggtgcggcattcggcccgattgtgattctgtccgtattgtggaaacgcatcactgcctacggcgcgttgtcaggcatggttgcaggtgcgtcaaccgttgttgtgtgggcggaatgggtaaaaaaaccggctcgagcggcaggcgaaagcggcttgttgacgatgtacgaaatcgtcccgggctttattgtttgcttgatcgttgccgtgttggtttccctgttcaacaaagaaccttcgcgcgaaatccaagaacgctttgaaaaagccgacgcagattaccgcgccgcccga

SEQ ID NO: 7826 - protein, 508 aa, Neisseria gonorrhoeae
MNPMYITFAIYLVAVLLIGLAAYFSTRNFDDYILGGRSLGPFVTAMSAGASDMSGWLLMGLPGAIYLSGLNEAWIAIGLLVGAYFNWLLVAGRLRVHTEYANNALTLPDYFFHRFGAGGHLMKVVSALIILFFFTIYCASGIVAGATLFQSLFEGMTYNQAMWLGAGATIAYTFLGGFLAVSWTDTLQASLMIFALILTPVMVYLGLGGAEQMSAAIQSVAAGTGKEYGSLFAGTTVIGIISTAAWGLGYFGQPHILARFMAAESAKSLVSARRIGMTWMALCLAGAVAVGYFGIAYFGANPDKVSSMSGNHERIFIALSTLLFNPWIAGIILSAILAAVMSTLSCQLLVCSSAITEDFYKGFLRKNAQQSELVWVGRLMVLAIAVISILIASDPNSKVLGLVSYAWAGFGAAFGPIVILSVLWKRITAYGALSGMVAGASTVVVWAEWVKKPARAAGESGLLTMYEIVPGFIVCLIVAVLVSLFNKEPSREIQERFEKADADYRAAR

SEQ ID NO: 7827 - DNA, 126 bp, Neisseria gonorrhoeae; identical to SEQ ID NO: 6805

SEQ ID NO: 7828 - protein, 42 aa, Neisseria gonorrhoeae; identical to SEQ ID NO: 6806

SEQ ID NO: 7829 - DNA, 123 bp, Neisseria gonorrhoeae
ttgtgttttacccgtttcattttcaaagaaacggaagcaccgattctgcccgcatttgaagccttgtatttcatctgcggatttattacgatattaccgtattcagaccgcaccgatgccgtc

SEQ ID NO: 7830 - protein, 41 aa, Neisseria gonorrhoeae
LCFTRFIFKETEAPILPAFEALYFICGFITILPYSDRTDAV

SEQ ID NO: 7831 - DNA, 189 bp, Neisseria gonorrhoeae
ttgcctcgccttgccgtactatttgtactgtctgcggcttcgtcgctttgtcctgatttaaatttaatccactatattttaaacaacaaagaattgaatttggaagaacggcatgatttggagcgggcggttaagatcttgcaggacacgcacgtcatcccggtttgtcggagaaagatgcatacgccg

SEQ ID NO: 7832 - protein, 63 aa, Neisseria gonorrhoeae
LPRLAVLFVLSAASSLCPDLNLIHYILNNKELNLEERHDLERAVKILQDTHVIPVCRRKMHTP

SEQ ID NO: 7833 - DNA, 354 bp, Neisseria gonorrhoeae
ttgaaaaagccgacgcagattaccgcgccgcccgataaacccctttcagacggcacggcatcccggttcgtgccgtctgaacccgcttccgggccaaacacaaataaaccttgcctgcatacaggccttatttgtgttttacccgtttcattttcaaagaaacggaagcaccgattctgcccgcatttgaagccttgtatttcatctgcggatttattacgatattaccgtattcagaccgcaccgatgccgtctgaaccccccgaaaaaactttggaggatccaaaaaatgtttcattttgcatttccggcacaaactgccctgcgccaagcgataaccgatgcctaccgccg

SEQ ID NO: 7834 - protein, 118 aa, Neisseria gonorrhoeae
LKKPTQITAPPDKPLSDGTASRFVPSEPASGPNTNKPCLHTGLICVLPVSFSKKRKHRFCPHLKPCISSADLLRYYRIQTAPMPSEPPEKTLEDPKNVSFCISGTNCPAPSDNRCLPP

SEQ ID NO: 7835 - DNA, 168 bp, Neisseria gonorrhoeae
ttgtgcctcaagaattttcagacggcattttttagtgaacaaaacaggatattttttatccataactttcctaaggcttgccccccgaaaaaaggtagaatcgggcttggtttgggcagaagcatccatctgattctaaggatggatgatgttttattctcaagtaaa

SEQ ID NO: 7836 - protein, 56 aa, Neisseria gonorrhoeae
LCLKNFQTAFFSEQNRIFFIHNFPKACPPKKGRIGLGLGRSIHLILRMDDVLFSSK

SEQ ID NO: 7837 - DNA, 180 bp, Neisseria gonorrhoeae; identical to SEQ ID NO: 6831

SEQ ID NO: 7838 - protein, 60 aa, Neisseria gonorrhoeae; identical to SEQ ID NO: 6832

SEQ ID NO: 7839 - DNA, 201 bp, Neisseria gonorrhoeae
ttggcgcagggcagtttgtgccggaaatgcaaaatgaaacattttttggatcctccaaagttttttcggggggttcagacggcatcggtgcggtctgaatacggtaatatcgtaataaatccgcagatgaaatacaaggcttcaaatgcgggcagaatcggtgcttccgtttctttgaaaatgaaacgggtaaaacacaaa

SEQ ID NO: 7840 - protein, 67 aa, Neisseria gonorrhoeae
LAQGSLCRKCKMKHFLDPPKFFRGVQTASVRSEYGNIVINPQMKYKASNAGRIGASVSLKMKRVKHK

SEQ ID NO: 7841 - DNA, 3513 bp, Neisseria gonorrhoeae
atgttgcaacgtgcacagatgagtgacgaagagcgcaacgccgcctccgagcttgcccgccgtttggttacccaagtccgcgccggccgcaccaaagccggcggcgtggatgcgctgatgcacgagttttcactctccagcgaagaaggcatcgcgctgatgtgtctggcagaagccctgctgcgtatccccgacaacgccacgcgcgaccgcctgattgccgacaagatttcagacggcaactggaaaagccatttgaacaacagcccttccctcttcgtcaatgctgccgcctggggtctgctgattaccggcaagctgaccgccacaaacgacaaacaaatgagttccgcactcggccgcctgatcggcaaaggcggcgcaccgctcatccgccaaggcgtaaattacgccatgcggcttctgggcaaacagttcgtcaccggacagaccattgaagaagccctgcaaaacggcaaagaacgcgaaaaaatgggctaccgcttctccttcgatatgttgggcgaagccgcctacacccaagccgatgccgaccgctactaccgcgactatgtcgaagccatccacgccatcggcaaagatgcggcaggacaaggcgtttacgaaggcaacggcatttccgtcaaactctccgccatccatccgcgctactcgcgcgcccaacacggccgcgtgatgggcgaactgttgcctcgcctgaaagaattgttccttttgggtaaaaaatacgatatcggtatcaacatcgatgccgaagaagccaaccgtctggagctgtctttggatttgatggaggcactcgtttccgaccccgatttggccggctacaaaggcatcggtttcgttgttcaagcctaccaaaaacgctgcccgttcgtcatcgactatctgattgacctggcccgccgcaacaaccaaaaactgatgatccgcctcgtcaaaggcgcgtattgggacagcgaaatcaaatgggcgcaagtggacggcttgaacggctatccgacctacacccgcaaagtgcataccgacatctcctacctcgcctgcgcgtgcaaactgctttccgcgcaagacgcggtattcccgcaattcgccacccacaacgcctacaccttgggcgcaatctaccaaatgggcaaaggcaaagattttgaacaccaatgcctgcacggtatgggcgaaaccttgtacgaccaagtcgtcggtccgcaaaacttaggccgccgcgtgcgcgtgtacgccccggtcggcacacacgaaaccctgctcgcctacttggtgcgccgcctgttggaaaacggcgcgaactcgtctttcgtcaaccaaatcgttgatgaaaacatcagcatcgaccgcctgattaagagcccgttcgacaccatcgccgaacaaggcatccacctgcacaacgccctgccgctgccgcgcgatttgtacggcaaatgccgtctgaactcgcaaggcgtggacttgagcaacgaaaacgtattgcagcagcttcaagaacagatgaacaaagccgccgcacaagacttccacgccgcatccatcgtcaacggcaaagcccgcgatgtcggcgaagcgcaaccgattaaaaaccctgccgaccacggcgatgttgtcggtacggtcagctttgccgatgccgcgcttgcccaagaagcggttggtgcagccgttgccgcgttccccgaatggagtgcgacacctgccgccgaacgcgccgcctgcctgcgccgtttcgccgacctgctcgaacagcacacccccgcgctgatgatgcttgccgtgcgcgaagcgggcaaaacgctgaacaacgccattgccgaagtgcgcgaagccgtcgatttctgccgctactacgcaaacgaagccgaacacaccctgcctcaagacgcaaaagccgtcggcgcgattgtcgccatcagcccgtggaacttcccgctcgccatctttaccggcgaagtcgtgtccgccctggcggcaggcaacaccgtcatcgccaaacctgccgaacaaaccagcctgattgccggttatgccgtttccctcatgcacgaagccggcatcccgacttccgccctgcaactcatcctcggcgcaggcgacacgggtgcggcattgaccaacgatgccagcatcggcggcgtgattttcacaggctcgaccgaagtggcgcgcctgatcaacaaagcccttgccaaacgcggcgacaatcccgtcctgattgccgaaaccggcggacaaaacgccatgattgtcgattccaccgcacttgccgaacaagtctgcgccgacgtattgaactccgccttcgacagcgcgggacaacgctgctccgccctgcgtatcttatgcgtccaagaagacgttgccgaccgtatgctcgacatgatcaaaggcgcgatggacgaactcgtcgtcggcaaaccgattcagctcactaccgatgtcggtcccgtcatcgatgccgaagcgcagcaaaacctgttgaaccacatcaacaaaatgaaaggcgttgccaagtcttaccacgaagtcaaagccgccgccgatgtcgattccgaaaaatccacgttcgttcgccccatcctgtttgaattgaacaacctcaacgaactgcaacgcgaagtcttcggccccgtcctgcacgtcgtccgctaccgcgccgacgaactcgacagcgtcatcgaccaaatcaacagcaaaggctacgccctgacccacggcgtacacagccgcatcgaaggcacggtacgccacatccgcagccgcatcgaagccggcaacgtttacgtcaaccgcaacatcgtcggtgcagtcgtcggcgtacagcccttcggcggacacggtctgtccggcacaggccccaaagcaggaggttcgttctacctgcaaaaactgacccgcatccccgaatgggttgccccgaccctgagccaaatcggacaggcagacgaagccgcgctcaaacgcctcgaagccctgattcacaaactgccgttcaacgccgaagagaaaaaagccgcagcggccgctttgggacacgcccgcatccgcaccctgcgccgtgccgaaaccgtccttaccggcccgaccggcgagcgcaacagcatctcatggcacgcgccaaaacgcgtttggatacacggcggcagcacggttcaagcctttgccgcactgaccggacttgccgcctccggcgtacaggcagtggtcgaacccgacagcccgctggcttcctacaccgccgacttggaaggtctgctgctggtcaacggcaaacccgaaaccgccggtatcagccacgttgccgccctgtcgcctttagacagcgcacgcaaacaggaacttgccgcccatgacggcgcactcatccgcgtcctcccttcggaaaacggactcgacatcctgcaagtgtttgaagaaatttcttgcagcatcaacaccacagccgccggcggcaacgccggcctgatggcggttgccgac

SEQ ID NO: 7842 - protein, 1171 aa, Neisseria gonorrhoeae
MLQRAQMSDEERNAASELARRLVTQVRAGRTKAGGVDALMHEFSLSSEEGIALMCLAEALLRIPDNATRDRLIADKISDGNWKSHLNNSPSLFVNAAAWGLLITGKLTATNDKQMSSALGRLIGKGGAPLIRQGVNYAMRLLGKQFVTGQTIEEALQNGKEREKMGYRFSFDMLGEAAYTQADADRYYRDYVEAIHAIGKDAAGQGVYEGNGISVKLSAIHPRYSRAQHGRVMGELLPRLKELFLLGKKYDIGINIDAEEANRLELSLDLMEALVSDPDLAGYKGIGFVVQAYQKRCPFVIDYLIDLARRNNQKLMIRLVKGAYWDSEIKWAQVDGLNGYPTYTRKVHTDISYLACACKLLSAQDAVFPQFATHNAYTLGAIYQMGKGKDFEHQCLHGMGETLYDQVVGPQNLGRRVRVYAPVGTHETLLAYLVRRLLENGANSSFVNQIVDENISIDRLIKSPFDTIAEQGIHLHNALPLPRDLYGKCRLNSQGVDLSNENVLQQLQEQMNKAAAQDFHAASIVNGKARDVGEAQPIKNPADHGDVVGTVSFADAALAQEAVGAAVAAFPEWSATPAAERAACLRRFADLLEQHTPALMMLAVREAGKTLNNAIAEVREAVDFCRYYANEAEHTLPQDAKAVGAIVAISPWNFPLAIFTGEVVSALAAGNTVIAKPAEQTSLIAGYAVSLMHEAGIPTSALQLILGAGDTGAALTNDASIGGVIFTGSTEVARLINKALAKRGDNPVLIAETGGQNAMIVDSTALAEQVCADVLNSAFDSAGQRCSALRILCVQEDVADRMLDMIKGAMDELVVGKPIQLTTDVGPVIDAEAQQNLLNHINKMKGVAKSYHEVKAAADVDSEKSTFVRPILFELNNLNELQREVFGPVLHVVRYRADELDSVIDQINSKGYALTHGVHSRIEGTVRHIRSRIEAGNVYVNRNIVGAVVGVQPFGGHGLSGTGPKAGGSFYLQKLTRIPEWVAPTLSQIGQADEAALKRLEALIHKLPFNAEEKKAAAAALGHARIRTLRRAETVLTGPTGERNSISWHAPKRVWIHGGSTVQAFAALTGLAASGVQAVVEPDSPLASYTADLEGLLLVNGKPETAGISHVAALSPLDSARKQELAAHDGALIRVLPSENGLDILQVFEEISCSINTTAAGGNAGLMAVAD

SEQ ID NO: 7843 - DNA, 669 bp, Neisseria gonorrhoeae; identical to SEQ ID NO: 4173

SEQ ID NO: 7844 - protein, 223 aa, Neisseria gonorrhoeae; identical to SEQ ID NO: 4174

SEQ ID NO: 7845 - DNA, 1467 bp, Neisseria gonorrhoeae
atggcggaaacgtttgcgctgacatttatgattgctgcgctgtatctgtttgcgcgttataaggcttcgcggctgctgattgcggtgtttttcgcgttcagcatgattgccaacaatgtgcattacgcggtttatcaaagctggatgacgggtattaactattggctgatgctgaaagaggttaccgaagtcggcagcgcgggcgcgtcgatgttggataagttgtggctgcctgctttgtggggcgtggcggaagtcatgttgttttgcagccttgccaagttccgccgtaagacgcatttttctgccgatatactgtttgccttcctaatgctgatgattttcgtgcgttcgttcgacacgaaacaagagcacggtatttcgcccaaaccgacatacagccgcatcaaagccaattatttcagcttcggttattttgtcgggcgcgtgttgccgtatcagttgtttgatttaagcaagatccctgtgttcaaacagcctgctccaagcaaaatcgggcaaggcagtattcaaaatatcgtcctgattatgggcgaaagcgaaagcgcggcgcatttgaaattgtttggttacgggcgcgaaacttcgccgtttttaacccggctgtcgcaagccgattttaagccgattgtgaaacaaagttattccgcaggctttatgacggcagtatccctgcccagtttctttaacgtcataccgcacgccaacggcttggaacaaatcagcggcggcgataccaatatgttccgcctcgccaaagagcagggctatgaaacgtatttttacagtgcccaggctgaaaaccaaatggcaattttgaacttaatcggtaagaaatggatagaccatctgattcagccgacgcaacttggctacggcaacggcgacaatatgcccgatgagaagctgctgccgttgttcgacaaaatcaatttgcagcagggcaggcattttatcgtgttgcaccaacgcggttcgcacgccccatacggcgcattgttgcagcctcaagataaagtattcggcgaagccgatattgtggataagtacgacaacaccatccacaaaaccgaccaaatgattcaaaccgtattcgagcagctgcaaaagcagcctgacggcaactggctgtttgcctatacctccgatcatggccagtatgtgcgccaagatatctacaatcaaggcacggtgcagcccgacagctatattgtgcctctggttttgtacagcccggataaggccgtgcaacaggctgccaaccaggcttttgcgccttgcgagattgccttccatcagcagctttcaacgttcctgattcacacgttgggctacgatatgccggtttcaggttgtcgcgaaggctcggtaacaggcaacctgattacgggcgatgcaggcagcttgaacattcgcaacggcaaggcggaatatgtttatccgcaa

SEQ ID NO: 7846 - protein, 489 aa, Neisseria gonorrhoeae
MAETFALTFMIAALYLFARYKASRLLIAVFFAFSMIANNVHYAVYQSWMTGINYWLMLKEVTEVGSAGASMLDKLWLPALWGVAEVMLFCSLAKFRRKTHFSADILFAFLMLMIFVRSFDTKQEHGISPKPTYSRIKANYFSFGYFVGRVLPYQLFDLSKIPVFKQPAPSKIGQGSIQNIVLIMGESESAAHLKLFGYGRETSPFLTRLSQADFKPIVKQSYSAGFMTAVSLPSFFNVIPHANGLEQISGGDTNMFRLAKEQGYETYFYSAQAENQMAILNLIGKKWIDHLIQPTQLGYGNGDNMPDEKLLPLFDKINLQQGRHFIVLHQRGSHAPYGALLQPQDKVFGEADIVDKYDNTIHKTDQMIQTVFEQLQKQPDGNWLFAYTSDHGQYVRQDIYNQGTVQPDSYIVPLVLYSPDKAVQQAANQAFAPCEIAFHQQLSTFLIHTLGYDMPVSGCREGSVTGNLITGDAGSLNIRNGKAEYVYPQ

SEQ ID NO: 7847 - DNA, 945 bp, Neisseria gonorrhoeae
ttggttggaaaccagcgggggcgacggttttgttttcctcttgacgcgcgagcagttattgggcgaagagtgagttggagggaaatgccgtctgaagacgatttgttttcagacggcatttttacgatacattgtttcgggtttgacgcttggttgagaaatccttaccatattgtttataagttaattgttttttatatcgctatcataatgaagaaattatctcggattgtattttcaatcgtactgttgggtttttcggccgctttgccggcgcagacctattctgtttattttaatcagaacgggaaactgacggcgacgatgtcttctgccgcttatatcaggcaatatagtgtggcggcgggtatcgcacacgcgcaggatttttattatccgtcgatgaagaaatattccgaaccttatatcgttgcttcaacgcaaatcaaatcttttgtgcctaccctgcaaaacggtatgttgattttgtggcattttaatggtcagaaaaaaatggcggggggcttcagcaagggtaagccggacggggaatgggtcaactggtatccgaacggtaaaaaatctgcggttatgccttataaaaatggcttgagtgagggtacgggataccgttattaccgtaacggcggcaaggaaagcgaaatccagtttaagcaaaataaggcgaacggcgtatggaagcaatggtatgccgatggaagtatcaagacggaaatggttatggtcaacgatgagcctgccaaaattctgacttgggatgaaagcggccgattactttcggaactgtctatccgccaccataaacgcaacggggtggttttggagtggtatgaagatggttctaaaaagagcgaggctgtttatcaggatgacaagttggtcaggaaaacccaatgggataaggatggttatttaatcgaaccc

SEQ ID NO: 7848 - protein, 315 aa, Neisseria gonorrhoeae
LVGNQRGRRFCFPLDARAVIGRRVSWREMPSEDDLFSDGIFTIHCFGFDAWLRNPYHIVYKLIVFYIAIIMKKLSRIVFSIVLLGFSAALPAQTYSVYFNQNGKLTATMSSAAYIRQYSVAAGIAHAQDFYYPSMKKYSEPYIVASTQIKSFVPTLQNGMLILWHFNGQKKMAGGFSKGKPDGEWVNWYPNGKKSAVMPYKNGLSEGTGYRYYRNGGKESEIQFKQNKANGVWKQWYADGSIKTEMVMVNDEPAKILTWDESGRLLSELSIRHHKRNGVVLEWYEDGSKKSEAVYQDDKLVRKTQWDKDGYLIEP

SEQ ID NO: 7849 - DNA, 309 bp, Neisseria gonorrhoeae
atggcaaaccaaaaaatccgtatccgcctgaaagcttatgattacgccctgattgaccgttctgcacaagaaatcgttgaaactgcaaaacgtaccggtgctgttgtaaaaggcccgattcctttgccgaccaaaatcgagcgtttcaacattttgcgttctccgcacgtgaacaaaacttcccgtgaacaattggaaatccgcacccatttgcgcctgatggacatcgtggattggaccgataaaactaccgatgcgctgatgaagctggatttgccggccggtgttgatgtagaaattaaagtccaa

SEQ ID NO: 7850 - protein, 103 aa, Neisseria gonorrhoeae
MANQKIRIRLKAYDYALIDRSAQEIVETAKRTGAVVKGPIPLPTKIERFNILRSPHVNKTSREQLEIRTHLRLMDIVDWTDKTTDALMKLDLPAGVDVEIKVQ

SEQ ID NO: 7851 - DNA, 327 bp, Neisseria gonorrhoeae
ttggactttaatttctacatcaacaccggccggcaaatccagcttcatcagcgcatcggtagttttatcggtccaatccacgatgtccatcaggcgcaaatgggtgcggatttccaattgttcacgggaagttttgttcacgtgcggagaacgcaaaatgttgaaacgctcgattttggtcggcaaaggaatcgggccttttacaacagcaccggtacgttttgcagtttcaacgatttcttgtgcagaacggtcaatcagggcgtaatcataagctttcaggcggatacggattttttggtttgccatttatcaatatccttcaat

SEQ ID NO: 7852 - protein, 109 aa, Neisseria gonorrhoeae
LDFNFYINTGRQIQLHQRIGSFIGPIHDVHQAQMGADFQLFTGSFVHVRRTQNVETLDFGRQRNRAFYNSTGTFCSFNDFLCRTVNQGVIISFQADTDFLVCHLSISFN

SEQ ID NO: 7853 - DNA, 558 bp, Neisseria gonorrhoeae
gtgtcggtcggctacgatttcggcagctggaggatagcggcagattatgcccgttacagaaagtggaacaacagtaaatattccgtcaacataaaaagggtgaaagaaaacaatggcagcgggaaaaaactgacgcaagacctgaagacggaaaatcaggaaaacggtacgttccacgccgtttcttctctcggcttgtccgccgtttacgatttcgataccggttcccgcttcaaaccctatgcaggcgtgcgcgtcagctacggacacgtcagacacagcatcgattcgaccaaaaaaacaacagatgttattaccgccccccccactacttctgacggagcacctacaacttataatgctaatccacagacgcaaaacccttatcaccaaagcgacagcatccgccgcgtgggcctcggcgtcatcgccggcgtcggtttcgacatcacgcccaacctgaccctggacaccggctaccgctaccacaactggggacgcctggaaaacacccgcttcaaaacccacgaagcctcattgggcatgcgctaccgcttc

SEQ ID NO: 7854 - protein, 186 aa, Neisseria gonorrhoeae
VSVGYDFGSWRIAADYARYRKWNNSKYSVNIKRVKENNGSGKKLTQDLKTENQENGTFHAVSSLGLSAVYDFDTGSRFKPYAGVRVSYGHVRHSIDSTKKTTDVITAPPTTSDGAPTTYNANPQTQNPYHQSDSIRRVGLGVIAGVGFDITPNLTLDTGYRYHNWGRLENTRFKTHEASLGMRYRF

SEQ ID NO: 7855 - DNA, 567 bp, Neisseria gonorrhoeae; identical to SEQ ID NO: 6853

SEQ ID NO: 7856 - protein, 189 aa, Neisseria gonorrhoeae; identical to SEQ ID NO: 6854

SEQ ID NO: 7857 - DNA, 129 bp, Neisseria gonorrhoeae
atgttcggattatactgtcagttatgccgtctgaaaatgccgtttgcccgatcttgcgccttaaaaatgccgtctgaaggttcagacggcatcggtatcggggaatcagaagcggtagcgcatgcccaa

SEQ ID NO: 7858 - protein, 43 aa, Neisseria gonorrhoeae
MFGLYCQLCRLKMPFARSCALKMPSEGSDGIGIGESEAVAHAQ

SEQ ID NO: 7859 - DNA, 402 bp, Neisseria gonorrhoeae
atgttccgcaaactgctggacgaaggtcaggcgggcgacaacgtaggcgtattgctgcgcggtaccaaacgtgaagacgtagaacgcggtcaggtattggccaaaccgggtactatcactcctcacaccaagttcaaagcagaagtgtacgtattgagcaaagaagagggcggccgccataccccgtttttcgccaactaccgtccccaattctacttccgtaccactgacgtaaccggcgcggttactttggaaaaaggtgtggaaatggtaatgccgggtgagaacgtaaccattactgtagaactgattgcgcctatcgctatggaagaaggtctgcgctttgcgattcgcgaaggcggccgtaccgtgggtgccggcgtggtttcttctgttatcgct

SEQ ID NO: 7860 - protein, 134 aa, Neisseria gonorrhoeae
MFRKLLDEGQAGDNVGVLLRGTKREDVERGQVLAKPGTITPHTKFKAEVYVLSKEEGGRHTPFFANYRPQFYFRTTDVTGAVTLEKGVEMVMPGENVTITVELIAPIAMEEGLRFAIREGGRTVGAGVVSSVIA

SEQ ID NO: 7861 - DNA, 297 bp, Neisseria gonorrhoeae; identical to SEQ ID NO: 6713

SEQ ID NO: 7862 - protein, 99 aa, Neisseria gonorrhoeae; identical to SEQ ID NO: 6714

SEQ ID NO: 7863 - DNA, 657 bp, Neisseria gonorrhoeae; identical to SEQ ID NO: 6863

SEQ ID NO: 7864 - protein, 219 aa, Neisseria gonorrhoeae; identical to SEQ ID NO: 6864

SEQ ID NO: 7865 - DNA, 120 bp, Neisseria gonorrhoeae; identical to SEQ ID NO: 6703

SEQ ID NO: 7866 - protein, 40 aa, Neisseria gonorrhoeae; identical to SEQ ID NO: 6704

SEQ ID NO: 7867 - DNA, 720 bp, Neisseria gonorrhoeae
atggctaaggaaaaattcgaacgtagcaaaccgcacgtaaacgttggcaccatcggtcacgttgaccatggtaaaaccaccctgactgctgctttgactactattttagctaaaaaattcggcggcgctgcaaaagcttacgaccaaatcgacaacgcacccgaagaaaaagcacgcggtattaccattaacacctcgcacgtagaatacgaaaccgaaacccgccactacgcacacgtagactgtccgggtcacgccgactacgttaaaaacatgattaccggcgccgcacaaatggacggtgcaatcctggtatgttctgctgccgacggccctatgccgcaaacccgcgaacacatcctgctggcccgtcaagtaggcgtaccttacatcatcgtgttcatgaacaaatgcgacatggtcgacgatgccgagctgttggaactggttgaaatggaaatccgcgacctgctgtccagctacgacttccccggcgacgactgcccgatcgtacaaggttccgcactgaaagccttggaaggcgatgccgcttacgaagaaaaaatcttcgaactggctaccgcattggacagctacatcccgactcccgagcgtgccgtggacaaaccattcctgctgcctatcgaagacgtgttctccattttccggccgcggtaccgtagtcaccggccgtgtagagcgaggtatcatccacgttgg

SEQ ID NO: 7868 - protein, 240 aa, Neisseria gonorrhoeae
MAKEKFERSKPHVNVGTIGHVDHGKTTLTAALTTILAKKFGGAAKAYDQIDNAPEEKARGITINTSHVEYETETRHYAHVDCPGHADYVKNMITGAAQMDGAILVCSAADGPMPQTREHILLARQVGVPYIIVFMNKCDMVDDAELLELVEMEIRDLLSSYDFPGDDCPIVQGSALKALEGDAAYEEKIFELATALDSYIPTPERAVDKPFLLPIEDVFSIFRPRYRSHRPCRARYHPRW

SEQ ID NO: 7869 - DNA, 426 bp, Neisseria gonorrhoeae
ttgcagggcgggcttcagcccgccgcatcaaggtttttggggaataggcgtgattcggcggaattgatggatttgacggaatcggcggcaatggcgggatcggtaatattgaagggattggtggaggccggcggcaacggcgggggcggaaaagacgcgccagccgccgaaatcgtagccgagggcgagtcgggggtggacggagcgggtgcggatgtttttgaaataatcgcttaccgtgcttattgttgtgcctttttttgcaccggttgcttcgggataatcgcgggtgatgtgctcgtaggcgtaagccagatccgcctgcacatacgggccgcgcccatggtcttcacccgccgcctgccaagcatcagggcgagcaggaggggtttgtattgcatggttcggctttcggaaaaaatcgga

SEQ ID NO: 7870 - protein, 142 aa, Neisseria gonorrhoeae
LQGGLQPAASRFLGNRRDSAELMDLTESAAMAGSVILKGLVEAGGNGGGGKDAPAAEIVAEGESGVDGAGADVFEIIAYRAYCCAFFCTGCFGIIAGDVLVGVSQIRLHIRAAPMVFTRRLPSIRASRRGLYCMVRLSEKIG

SEQ ID NO: 7871 - DNA, 2103 bp, Neisseria gonorrhoeae
atggctcgtaagaccccgatcagcctgtaccgcaacatcggtatttccgcccatatcgatgcgggtaaaaccacgacgacagaacgtattttgttctataccggtttgacccacaagctgggcgaagtgcatgacggtgcggctactaccgactacatggaacaagagcaagagcgcggtattaccattacctccgctgccgttacttcctactggtccggtatggcgaaacaattccccgagcaccgcttcaacatcatcgacaccccggggcacgttgactttaccgtagaggtagagcgttctatgcgtgtattggacggcgcggtaatggtttactgtgcggtgggcggtgttcaaccgcaatctgaaaccgtatggcggcaagccaacaaataccaagttccgcgcttggcgtttgtcaataaaatggaccgccaaggtgccaacttcttccgcgttgtcgagcaaatgaaaacccgtttgcgcgcaaaccccgtacctatcgtcattccggtaggcgcggaagacagttttaccggtgttgtcgatttgctgaaaatgaaatctatcatctggaatgaagccgataaaggtacaacctttacctatggcgatattcctgccgaattggtcgaaactgccgaagaatggcgtcaaaatatgattgaagccgcagccgaagccagcgaagaactgatggacaaatacttgggcggtgaagatctggccgaagaagaaatcgtaggcgcgttgcgtcaacgtactttggcaggcgaaattcagcctatgctgtgcggttctgcatttaaaaacaaaggtgttcaacgtatgttggacgcagttgtagaattgctgccagctcctaccgatattcctccggttcaaggtgttaatcctaacactgaagaagccgacagccgtcaagccagcgatgaagagaaattctctgcattggcattcaaaatgttgaacgacaaatacgtcggtcagctgacctttatccgcgtttactcaggcgtagtaaaatccggcgataccgtactgaattctgtaaaaggcactcgcgaacgtatcggtcgtttggtgcaaatgactgccgcagaccgtactgaaatcgaagaagtacgcgctggcgacatcgcagccgctatcggtctgaaagacgttactaccggtgaaaccttgtgtgcggaaagcgcgccgattatcttggaacgtatggaattccccgagccggtaatccatattgccgttgagccgaaaaccaaagccgaccaagagaaaatgggtatcgccctgaaccgcttggctaaagaagacccttctttccgcgttcgtacagacgaagaatccggtcaaaccattatttccggtatgggtgagctgcacttggaaattattgttgaccgtatgaaacgcgaattcggtgtggaagcaaatatcggtgcacctcaagtggcttaccgtgaaactatccgcaaagccgttaaagctgaatacaaacatgcaaaacaatccggtggtaaaggtcaatacggtcacgttgtgattgaaatggaacctatggaaccgggtggtgaaggttacgagtttatcgatgaaattaaaggtggtgtgattcctcgcgaatttattccgtctgtcgataaaggtatccgcgatacgttgcctaacggtatcgttgccggctatcctgtagttgacgtacgtatccgtctggtattcggttcttaccatgatgtcgactcttcccaattggcatttgaattggctgcttctcaagcgtttaaagaaggtatgcgtcaagcatctcctgccctgcttgagccgattatggcagttgaagtggaaactccggaagaatacatgggcgacgtaatgggcgacttgaaccgccgtcgcggtgttgtattgggtatggatgatgacggtatcggcggtaaaaaagtccgtgccgaagtacctctggcagaaatgttcggttactcgaccgacctgcgttctgcaacccaaggccgcgctacttactctatggagttcaagaaatattctgaagctcctgcccacatagctgctgctgtaactgaagcccgtaaaggc

SEQ ID NO: 7872 - protein, 701 aa, Neisseria gonorrhoeae
MARKTPISLYRNIGISAHIDAGKTTTTERILFYTGLTHKLGEVHDGAATTDYMEQEQERGITITSAAVTSYWSGMAKQFPEHRFNIIDTPGHVDFTVEVERSMRVLDGAVMVYCAVGGVQPQSETVWRQANKYQVPRLAFVNKMDRQGANFFRVVEQMKTRLRANPVPIVIPVGAEDSFTGVVDLLKMKSIIWNEADKGTTFTYGDIPAELVETAEEWRQNMIEAAAEASEELMDKYLGGEDLAEEEIVGALRQRTLAGEIQPMLCGSAFKNKGVQRMLDAVVELLPAPTDIPPVQGVNPNTEEADSRQASDEEKFSALAFKMLNDKYVGQLTFIRVYSGVVKSGDTVLNSVKGTRERIGRLVQMTAADRTEIEEVRAGDIAAAIGLKDVTTGETLCAESAPIILERMEFPEPVIHIAVEPKTKADQEKMGIALNRLAKEDPSFRVRTDEESGQTIISGMGELHLEIIVDRMKREFGVEANIGAPQVAYRETIRKAVKAEYKHAKQSGGKGQYGHVVIEMEPMEPGGEGYEFIDEIKGGVIPREFIPSVDKGIRDTLPNGIVAGYPVVDVRIRLVFGSYHDVDSSQLAFELAASQAFKEGMRQASPALLEPIMAVEVETPEEYMGDVMGDLNRRRGVVLGMDDDGIGGKKVRAEVPLAEMFGYSTDLRSATQGRATYSMEFKKYSEAPAHIAAAVTEARKG

SEQ ID NO: 7873 - DNA, 339 bp, Neisseria gonorrhoeae
ttgatgcggcgggctgaagcccgccctgcaaccctctctatgcacccccttgcgagcccgacactacgcaacatcttgagaacccatcctgtcaagaatacccgaaccgtcccgatacaccgtaatcctaaaacccgtcattcccgcgctgcaatgggacatcggcggcagcggggcggttttcccttcgctcgcactgtttctgctctgtttcatcataggtatgcacaacacggggatgacgcttctgccgggcggtgcaatccgttcgacgcacatggcccggcacggcagccgacttgggcatcgaaatcccgcgcgtgccgtactatagtggat

SEQ ID NO: 7874 - protein, 113 aa, Neisseria gonorrhoeae
LMRRAEARPATLSMHPLASPTLRNILRTHPVKNTRTVPIHRNPKTRHSRAAMGHRRQRGGFPFARTVSALFHHRYAQHGDDASAGRCNPFDAHGPARQPTWASKSRACRTIVD

SEQ ID NO: 7875 - DNA, 468 bp, Neisseria gonorrhoeae
atgccaagacgtagagaagtccccaagcgcgacgtactgccagatcctaaattcggtagcgtcgagttgaccaaattcatgaacgtattgatgattgacggtaaaaaatccgttgccgagcgtatcgtttacggtgcgttggaacagattgagaaaaaaaccggcaaagcagcaatcgaagtatttaacgaagccattgcaaactccaaacctatcgtggaagtgaaaagccgccgtgtaggtggtgcaaactaccaagttcctgttgaagttcgtccttcacgccgtctggctttggcaatgcgttgggttcgcgacgcggcccgcaaacgtggtgagaaatccatggatctgcgtttggcaggcgagttgattgatgcgtccgaaggccgtggcggtgcgttgaaaaaacgtgaagaagtacaccgtatggctgaagccaacaaagcattctctcacttccgtttc

SEQ ID NO: 7876 - protein, 156 aa, Neisseria gonorrhoeae
MPRRREVPKRDVLPDPKFGSVELTKFMNVLMIDGKKSVAERIVYGALEQIEKKTGKAAIEVFNEAIANSKPIVEVKSRRVGGANYQVPVEVRPSRRLALAMRWVRDAARKRGEKSMDLRLAGELIDASEGRGGALKKREEVHRMAEANKAFSHFRF

SEQ ID NO: 7877 - DNA, 111 bp, Neisseria gonorrhoeae
atggtgtccgattttatggcagccccacgcgccgacgatgccgccgagcagccatattttcggtttgtcgacgtgtacgtgcggcaggcgcggatggtgggtttaggaata

SEQ ID NO: 7878 - protein, 37 aa, Neisseria gonorrhoeae
MVSDFMAAPRADDAAEQPYFRFVDVYVRQARMVGLGI

SEQ ID NO: 7879 - DNA, 417 bp, Neisseria gonorrhoeae
ttgccgacatggtgtcggcaaatatttaactcaacaggacgagaaaatatgccaactatcaaccaattggtacgcaaaggccgtcaaaagcccgtgtacgtaaacaaagtgcccgcactggaagcctgcccgcaaaaacgcggcgtgtgcacccgtgtatacacgactacccctagaaaacctaactctgcattgcgtaaagtatgtaaagtccgcctgaccaacggttttgaagtcatttcatatatcggcggtgaaggccacaacctgcaagagcacagcgtcgtactgattcgcggcggccgtgtaaaagacttgccgggtgtacgttaccacactgtacgcggttctttggatactgcaggtgttaaagaccgcaaacaagcccgttctaaatacggtgctaagcgtcctaaa

SEQ ID NO: 7880 - protein, 139 aa, Neisseria gonorrhoeae
LPTWCRQIFNSTGRENMPTINQLVRKGRQKPVYVNKVPALEACPQKRGVCTRVYTTTPRKPNSALRKVCKVRLTNGFEVISYIGGEGHNLQEHSVVLIRGGRVKDLPGVRYHTVRGSLDTAGVKDRKQARSKYGAKRPK

SEQ ID NO: 7881 - DNA, 207 bp, Neisseria gonorrhoeae; identical to SEQ ID NO: 4189

SEQ ID NO: 7882 - protein, 69 aa, Neisseria gonorrhoeae; identical to SEQ ID NO: 4190

SEQ ID NO: 7883 - DNA, 735 bp, Neisseria gonorrhoeae
atgcccgatttccaccagcaatacacctttaggattcagaaactttgccgcattcagaagaatctgcctggtggcatccaacccgtccgccccgctgcccaacgccaattccggttcgtgcaaatattcctcaggcaaagccccaaccgactctgcatccacataaggcggattggaaacaatcaaatcataagtgccttccagtccctcaaacaaatcggtatgaataagctgaatacgctcttccagaccataatcttcaatattgatccctgcaacttccaaagcatccaaactcacatcaaccgcatcaatttgggcatcaggataatggtgcgccatctgaatggcaaggcaaccgcttccggtgcaaagatccaaagcattatgcaccagctcatcgtattctatccaaggtcgaagtccgtcacccagcaattcataaataaaagagcgcggtacaatcacgcgttcatctacataaaaatcaaactccccctgccaggcctggtgtgtcaaataagcggcaggaatgtgttcgacagcacgacgctcaataaccgccagcacttcctctttttcagcttccaagagttttgcatcaagatatggggcaagcatatccaaaggcaaattcaaagtatgcagaatcaaataaaccgcttcatcatgcgcattatctgttccatgaccaaaaaagagccctgcctcattaaaacggctgactgcaaaacg

SEQ ID NO: 7884 - protein, 245 aa, Neisseria gonorrhoeae
MPDFHQQYTFRIQKLCRIQKNLPGGIQPVRPAAQRQFRFVQIFLRQSPNRLCIHIRRIGNNQIISAFQSLKQIGMNKLNTLFQTIIFNIDPCNFQSIQTHINRINLGIRIMVRHLNGKATASGAKIQSIMHQLIVFYPRSKSVTQQFINKRARYNHAFIYIKIKLPLPGLVCQISGRNVFDSTTLNNRQHFLFFSFQEFCIKIWGKHIQRQIQSMQNQINRFIMRIICSMTKKEPCLIKTADCKT

SEQ ID NO: 7885 - DNA, 129 bp, Neisseria gonorrhoeae
ttgccgataccgggtgcaggctcggtcggctacgatgtgaaggtacgtttttttgcggatgtggctgcggtttcggcgcaaatcacgataaacccgcgttgtttcgggaaaaatcgggtaatttcaggt

SEQ ID NO: 7886 - protein, 43 aa, Neisseria gonorrhoeae
LPIPGAGSVGYDVKVRFFADVAAVSAQITINPRCFGKNRVISG

SEQ ID NO: 7887 - DNA, 171 bp, Neisseria gonorrhoeae; identical to SEQ ID NO: 6901

SEQ ID NO: 7888 - protein, 57 aa, Neisseria gonorrhoeae; identical to SEQ ID NO: 6902

SEQ ID NO: 7889 - DNA, 720 bp, Neisseria gonorrhoeae; identical to SEQ ID NO: 25

SEQ ID NO: 7890 - protein, 240 aa, Neisseria gonorrhoeae
LLIVVRFDICTEGNAMTFFKPSTVVLTASALALSGCVADPVTGQQSPNKSAMYGLGGAAVCGIVGALTHSGKGARNSALACGAIGAGVGGYMDYQEQRLRQNLAGTQIEIQRQGNQIRLVMPESVTFATGSAALGGSAQYALNTAAQTLVQYPDTTLTINGHTDNTGSDAVNNPLSQHRAQAVAYYLQTRGVAASRLTVYGYGSHMPVASNATVEGRAQNRRVEILINPDQRAVNAARHM

SEQ ID NO: 7891 - DNA, 150 bp, Neisseria gonorrhoeae
atggtttgtcagtatggaaaaaacgtattgacagtattttctccagccgtccgactgattgtgagggatgtcggtaaatatttatcggcaaacaagaaaatcatcttttttcttgtcgttatgcttgactgtctgcttgcaataaaaata

SEQ ID NO: 7892 - protein, 50 aa, Neisseria gonorrhoeae
MVCQYGKNVLTVFSPAVRLIVRDVGKYLSANKKIIFFLVVMLDCLLAIKI

SEQ ID NO: 7893 - DNA, 765 bp, Neisseria gonorrhoeae
ttggcgttgcagggcgcgttacatgtgccgtgcggcgttgacggcgcgttggtcggggttgatgaggatttcgacgcggcggttttgcgcgcggccttcaaccgtagcgttggacgcgaccggcatatgcgaaccgtagccgtaaaccgtcaggcgcgaagccgccacgccgcgcgtctgcagatagtaggcaaccgcttgggcgcggtgttgcgaaagcggattgttgactgcatcggaacctgtgttgtcggtgtgcccgttgatggtcagcgtcgtgtcgggatactgcaccagcgtctgtgcggcagtgttcagggcgtattgcgcactgccgcccaacgccgcgctgccggtggcgaaggtaacgctttcgggcatcaccagcctgatttggttgccttggcgttggatttcgatttgcgtgccggcaaggttttggcgcaaacgctgctcttggtagtccatatagccgcccacgcctgcgccgattgcgccgcaggcaagcgcggaattgcgtgcgcctttgccgctgtgggtcagtgcgccgacgatgccgcacactgccgcgccacccaaaccgtacatggcggatttgtttggggactgctgtccggttacggggtcggcaacgcagccggaaagcgcgagtgcggatgcggtcagcacgacggtagagggtttgaagaaagtcatggcgtttccttccgtgcatatgtcaaaccgtacaactataagcaatcatgccgtctgaaaaagtgcaat

SEQ ID NO: 7894 - protein, 255 aa, Neisseria gonorrhoeae
LALQGALHVPCGVDGALVGVDEDFDAAVLRAAFNRSVGRDRHMRTVAVNRQARSRHAARLQIVGNRLGAVLRKRIVDCIGTCVVGVPVDGQRRVGILHQRLCGSVQGVLRTAAQRRAAGGEGNAFGHHQPDLVALALDFDLRAGKVLAQTLLLVVHIAAHACADCAAGKRGIACAFAAVGQCADDAAHCRATQTVHGGFVWGLLSGYGVGNAAGKRECGCGQHDGRGFEESHGVSFRAYVKPYNYKQSCRLKKCN

SEQ ID NO: 7895 - DNA, 144 bp, Neisseria gonorrhoeae
atggataacgtctcgccgtttgccgggaaaccgcagattgcagccggtggcgtgcaagtgggcccaaccttgcagacgttaccgccataccgcgatacccctgtaacctcatcgtttaaacagatattcaatcaaaatgccgtc

SEQ ID NO: 7896 - protein, 48 aa, Neisseria gonorrhoeae
MDNVSPFAGKPQIAAGGVQVGPTLQTLPPYRDTPVTSSFKQIFNQNAV

SEQ ID NO: 7897 - DNA, 147 bp, Neisseria gonorrhoeae
atgagcgcggctttatggcataaaaaactgtcgtggaaaggatttacaccccaaataaatttccgttacaacaagaacaacagcaatatgcccgccttttattcgcacagcggcaagggatggtttgtcagtatggaaaaaacgtat

SEQ ID NO: 7898 - protein, 49 aa, Neisseria gonorrhoeae
MSAALWHKKLSWKGFTPQINFRYNKNNSNMPAFYSHSGKGWFVSMEKTY

SEQ ID NO: 7899 - DNA, 927 bp, Neisseria gonorrhoeae
atgttcgaggcggccgatctataccgtgagttgttgtcggaaagacccgatcttgtttatccccgttttgatttgggcgtgatgctgtttgaagacaaacaatatcgtgaggcattggttcagttgcaccgggccgaggaggtgttgccgcccgatatgcggcagcttgcacgggaatatatccgtcaggcggaagcggtgcaggcgtggcatccttcgttcaatatgaactatgaacaaacagataatgtaaacaatgcgtccctttcacgggacatcgtcatcaacggccggaaatggataaaatcggaagacagcctgcccaaacgcgccaacgggataaggtacgaactgggcgttgatcggatgtttaacatggcaggcaatcactttgcccgcttaggcatcagcggttccggtgtgcattattggaatgcccgggattttagcgaacaggcgtttcatgccgaagtaggctaccgttatcggaatagccgtctagagtggggattccggccctttgtcaaacaaaaccggctgggcaataaccgttatacggcaaatacgggtattgtgttggattacagccgccgtctgaatgaaaaatggcgcagcacccaatctttccagtatggccgcaaacaataccatgacgaatatttggcaaaacgttacaacagtaaaacgatttcggtgagcggtacgttcagctattacgctatgtcggcttggcagttgtacgggggtattagcggtatgtttgataatactgtggagaaagagcaggcttcacggcgttatggtgtaagtttgggtacggtgaaaatattagacggcggtcttggactgaagttgggtgcgggttacacgaaacggatatttaaagcccctgcaacattaatttacaattttactcggcgtgatgat

SEQ ID NO: 7900 - protein, 309 aa, Neisseria gonorrhoeae; identical to SEQ ID NO: 160

SEQ ID NO: 7901 - DNA, 768 bp, Neisseria gonorrhoeae
atgaaaatcaccacttggaacgtcaattcgctcaatgtgcggctgccgcaggtgcaaaacctgcttgtcgacaatccgcccgatattttggttttgcaggaactcaaactcgatcaggacaaatttccggccgccgccttgcagatgatgggctggcactgtgtttggagcgggcagaaaacctacaacggcgtggcaatcgtcagccgcagcgtgccgcaggacgtgcatttcggtttgccttccctgccggatgacccgcaacgccgcgtgattgcggcgaccgtcggcggcgtgcgcgtcatcaatgtctattgcgtcaacggcgaagccctcgacagccccaaattcaaatataaggaacaatggtttgccgcactgacggagtttgtccgcgatgaaatgtcccgccacggcaaactggtgctgctgggcgatttcaatatcgcgcctgccgatgcggactgttacgaccctgaaaaatggtatgaaaaaatccactgttcgtccgtcgaacggcagtggtttcaaaacctgctggatttgggattgaccgacagcctgcgccaagtccatcccgaaggcgcgttctatacctggttcgactatcgcggcgcgatgttccaacgcaaactgggcctgcgtatcgaccatatattggttacatccgaaatggcggccgttttgaaggatgtccgcatcgatttggagacgcgcgcgctggagcgtccgagcgaccacgcgcccgtggcggcagaatttgatttg

SEQ ID NO: 7902 - protein, 256 aa, Neisseria gonorrhoeae
MKITTWNVNSLNVRLPQVQNLLVDNPPDILVLQELKLDQDKFPAAALQMMGWHCVWSGQKTYNGVAIVSRSVPQDVHFGLPSLPDDPQRRVIAATVGGVRVINVYCVNGEALDSPKFKYKEQWFAALTEFVRDEMSRHGKLVLLGDFNIAPADADCYDPEKWYEKIHCSSVERQWFQNLLDLGLTDSLRQVHPEGAFYTWFDYRGAMFQRKLGLRIDHILVTSEMAAVLKDVRIDLETRALERPSDHAPVAAEFDL

SEQ ID NO: 7903 - DNA, 282 bp, Neisseria gonorrhoeae
atggcgttgctgggcattttatttgaatttgttatgaaattgatgaaatctaaaaatatcttttttatgggatacctaatcgcttcggcgacgtttgccgaggatatcggcgtgcctgtcgaaccgattaacgtcggtagtcgggctgcgatgccgtctgaaggggaaagcctcgccctcctgccgtttgcagaggatgtgccgccggttcgcgatgcaatgccgtctgaagttcctaaaagcgcggcaggcggcgatgttcgaggcggccgatctataccg

SEQ ID NO: 7904 - protein, 94 aa, Neisseria gonorrhoeae
MALLGILFEFVMKLMKSKNIFFMGYLIASATFAEDIGVPVEPINVGSRAAMPSEGESLALLPFAEDVPPVRDAMPSEVPKSAAGGDVRGGRSIP

SEQ ID NO: 7905 - DNA, 795 bp, Neisseria gonorrhoeae
gtggtcgctcggacgctccagcgcgcgcgtctccaaatcgatgcggacatccttcaaaacggccgccatttcggatgtaaccaatatatggtcgatacgcaggcccagtttgcgttggaacatcgcgccgcgatagtcgaaccaggtatagaacgcgccttcgggatggacttggcgcaggctgtcggtcaatcccaaatccagcaggttttgaaaccactgccgttcgacggacgaacagtggattttttcataccatttttcagggtcgtaacagtccgcatcggcaggcgcgatattgaaatcgcccagcagcaccagtttgccgtggcgggacatttcatcgcggacaaactccgtcagtgcggcaaaccattgttccttatatttgaatttggggctgtcgagggcttcgccgttgacgcaatagacattgatgacgcgcacgccgccgacggtcgccgcaatcacgcggcgttgcgggtcatccggcagggaaggcaaaccgaaatgcacgtcctgcggcacgctgcggctgacgattgccacgccgttgtaggttttctgcccgctccaaacacagtgccagcccatcatctgcaaggcggcggccggaaatttgtcctgatcgagtttgagttcctgcaaaaccaaaatatcgggcggattgtcgacaagcaggttttgcacctgcggcagccgcacattgagcgaattgacgttccaagtggtgattttcataacatttccgaaaaatgccgtctgaaacgttcagacggcaaaagaaaaggattc

SEQ ID NO: 7906 - protein, 265 aa, Neisseria gonorrhoeae
VVARTLQRARLQIDADILQNGRHFGCNQYMVDTQAQFALEHRAAIVEPGIERAFGMDLAQAVGQSQIQQVLKPLPFDGRTVDFFIPFFRVVTVRIGRRDIEIAQQHQFAVAGHFIADKLRQCGKPLFLIFEFGAVEGFAVDAIDIDDAHAADGRRNHAALRVIRQGRQTEMHVLRHAAADDCHAVVGFLPAPNTVPAHHLQGGGRKFVLIEFEFLQNQNIGRIVDKQVLHLRQPHIERIDVPSGDFHNISEKCRLKRSDGKRKGF

SEQ ID NO: 7907 - DNA, 240 bp, Neisseria gonorrhoeae; identical to SEQ ID NO: 6933

SEQ ID NO: 7908 - protein, 80 aa, Neisseria gonorrhoeae; identical to SEQ ID NO: 6934

SEQ ID NO: 7909 - DNA, 279 bp, Neisseria gonorrhoeae
atgaacacaataccgctccacaccatactcaaacttatggcgcatcccgaacgtatggcgatactgatccaactgttggacagcgaacgcaatatcgtcgaactggcaaaatccttatccctgacggccaccgcggtttcctgtcatttgaaccgcctgagggcgggcggtctggtggactttacgcgttaccaccgcattatcgaataccgcctggtttccgaagacgcggcaacgattctgcggacaatccgcgatttggaaaacaaacgcgcggca

SEQ ID NO: 7910 - protein, 93 aa, Neisseria gonorrhoeae
MNTIPLHTILKLMAHPERMAILIQLLDSERNIVELAKSLSLTATAVSCHLNRLRAGGLVDFTRYHRIIEYRLVSEDAATILRTIRDLENKRAA

SEQ ID NO: 7911 - DNA, 963 bp, Neisseria gonorrhoeae; identical to SEQ ID NO: 215

SEQ ID NO: 7912 - protein, 321 aa, Neisseria gonorrhoeae; identical to SEQ ID NO: 216

SEQ ID NO: 7913 - DNA, 135 bp, Neisseria gonorrhoeae; identical to SEQ ID NO: 6949

SEQ ID NO: 7914 - protein, 45 aa, Neisseria gonorrhoeae; identical to SEQ ID NO: 6950

SEQ ID NO: 7915 - DNA, 3228 bp, Neisseria gonorrhoeae
atgcaaaatatgaaaaaccaagtacgcggatcaggcatggatgcccgatccaacccggccaatgtttcagacggcctgcaaaacagttcgggccatatcggtaccaacacgcgctaccgcctgaccaagctcggcgaacaaatggcgcgcctgcccatcgatccgaaaattgcgcgcattttgctggcggcgaagaaacacgactgcatggcggaaatattggtgattgcgtctgcgctgtcgattcaagacccgcgcgaacggccgctggaagcgcgcgatgccgcggccaaggcgcatgaacgctttaccgacaagcaatccgatttccttacctacctgaatatttgggacagtttccagcgcgagcgcgacaaaggtttgtccaacaagcagttggtgcaatggtgccgtcaatattttctgtcgcacctgaggatgcgcgagtggcgcgagctgcaccaccagcttgcccaaaccgcgattgaaatgggcttgaccaccaaagaagctgcgtttagacgacctcccgaagtcaagcaactgacgtcgtctgagaatgcgggcgaccaagacctatctgccaaactcaaacaaaaacaactggataagaaacaacaccgcacccaaatccgcgctaccaaagaagcaggctacgaacaaatccaccgcgccctgctcaccggcctcatcgccaacgtcggcatgaaatcgcccgacagcaacgactacaccggcgcgcgcggcagccgcttccaccttttccccgcctccgccctgttcaaagccaagcccaaatgggtgatggcggcagaattggttgaaaccacgcgcctttacgcgcgcgacgtcgccgttatccagcccgaatggatcgagcaggaagccccgcaccttgtccgctaccattatttcgagccgcactgggaacaaaaacgcggcgaagtcgtcgccagcgaacgcgtaacgttttacggcctgaccgtattgccgcgccgccccgtgtcttacggtaaagttgcgcccgaagaagcacgtgaaatctttatccgcagcgcgttggtggcgcaggaatacgatttgaaagcggatttttttgtccacaacaaaaagctgattaaagaaattaccgaactcgaacacaaatcgcgcaagcaagacgtattggtcgatgacgaagccctgtttgcgttttatcacgaacggctgcccgatttttatatggcggattcggtttcagagggcctgtgtcctgcaaatccgcagcaaaccaccccctcccccgtggggaaaggctggggagagggcaaaacagttgccgcacaaaccaacttttccgcaaccgcagcaaaccctctccctaaccctctcccacaggagagggaacagagtgcctcagtttcaacggtttcaggcagtctgaaaacaatgtcttgcgaagcaaggctgaatttctgcgaagctaaaactaaaaccgaaagcagcctgcactcccaaaggctatctgaaaactacaccccgccattttcagacggcctgcgtcctgcaaacccccagcaaaccaccccctcccccgtgggggagggctggggagagggcaaaacagttgccgcacaaaccaacttttccgcaaccgcagcaaaccctctcccacaggagagggaacagagtgcctcggctttaacagtttcagatgaccccaaacccaaaaagcagcctgcatctcaaaaaggccgtctgaaacctttgccccttgccgatatccgcacctttgaagcctggctcaaaaccgccgagcgcgacaacccgcgcctgttgttcctcagccgcgacgacctcatgcagcacgccgccgcgcacatcaccgaagaacaattccccaaacactggcagaccgcagacggcaaattcaaactcagctaccgcttcgagccgcaccacccgctcgacggcgttaccctcaccctgccgctcaccgtgctcaaccgcatcagccccgccgccctcgaatggctcgtgcccggcatgatacgcgaaaaaatccagctacaaatcaaagcactgcccaaacaaatccgccgcatctgcgtacccgtacccgaattcatcacccaatttttaagccaaaaccccgaccgcaacgcccccatcctgccccagctcgcccaagccatcgccaaaaccgcaggcgacatccgcatactcgagcaaatcaaccaagacgaatgggccgcgttcaggctgcccgaacactgctatttcaacctccgcatcatcgacgacggcgaacaagagttagccatgggtcgcgatttaatccaaatccaacaacaacttggcaaagccgccaccaccaccttccgcgacaacacccaagaattcgagcgtgacaacgttaccgcatgggacatcggcatcctgcccgaatccatcaaattcgcccgcggcaaacaacagctcaccggctacctcggcctgcaaaaagaaaaagacggccgcatcgccctgcgcctgttcgacacgtctgccgccgccggacacgcccacagattaggcgtgattgaactcatgaaactacaactaaaagaacaagttaaagatctgaacaaaggcatccaaggcttcacccaagccgccatgctgctcaaacacatcaacgccgacaccctgcgcgacgacctcacccaagccgtctgcgaccgcgcctttatcggcgaagacaagctgccgcgcaacgaaaaagccttcaaagaacaaatcaaacgcgcccgcagccgcctgcccgccgtcaaagaagccctcagccgctacctgcaggaaaccgcagccgcctacgccgaactgaacggcaaactcggcaaacacccattgacccacctcctaagactacgcctgcaaaccctgcttgcacccggcttcgccacccgcaccccgtgggcacaatggccgcgcctccccatctacctcaaagccatgaccctgcgcctcgaaaaatacagcagcaaccccgcccgcgacgcagcccgcgaagccgatatccaagagctggaacaaatgtggcaggaaaaaactgacggcttggcgaaacaaggacagcccgtttcagacggcctcgccgcgtttaaatggatgattgaagaattgagagtgtcgctgttcgcgcaggagttgaagacgccgtatccggtgtcggtgaagcggctgttgaagatgtgggagatactactt

SEQ ID NO: 7916 - protein, 1076 aa, Neisseria gonorrhoeae
MQNMKNQVRGSGMDARSNPANVSDGLQNSSGHIGTNTRYRLTKLGEQMARLPIDPKIARILLAAKKHDCMAEILVIASALSIQDPRERPLEARDAAAKAHERFTDKQSDFLTYLNIWDSFQRERDKGLSNKQLVQWCRQYFLSHLRMREWRELHHQLAQTAIEMGLTTKEAAFRRPPEVKQLTSSENAGDQDLSAKLKQKQLDKKQHRTQIRATKEAGYEQIHRALLTGLIANVGMKSPDSNDYTGARGSRFHLFPASALFKAKPKWVMAAELVETTRLYARDVAVIQPEWIEQEAPHLVRYHYFEPHWEQKRGEVVASERVTFYGLTVLPRRPVSYGKVAPEEAREIFIRSALVAQEYDLKADFFVHNKKLIKEITELEHKSRKQDVLVDDEALFAFYHERLPDFYMADSVSEGLCPANPQQTTPSPVGKGWGEGKTVAAQTNFSATAANPLPNPLPQEREQSASVSTVSGSLKTMSCEARLNFCEAKTKTESSLHSQRLSENYTPPFSDGLRPANPQQTTPSPVGEGWGEGKTVAAQTNFSATAANPLPQEREQSASALTVSDDPKPKKQPASQKGRLKPLPLADIRTFEAWLKTAERDNPRLLFLSRDDLMQHAAAHITEEQFPKHWQTADGKFKLSYRFEPHHPLDGVTLTLPLTVLNRISPAALEWLVPGMIREKIQLQIKALPKQIRRICVPVPEFITQFLSQNPDRNAPILPQLAQAIAKTAGDIRILEQINQDEWAAFRLPEHCYFNLRIIDDGEQELAMGRDLIQIQQQLGKAATTTFRDNTQEFERDNVTAWDIGILPESIKFARGKQQLTGYLGLQKEKDGRIALRLFDTSAAAGHAHRLGVIELMKLQLKEQVKDLNKGIQGFTQAAMLLKHINADTLRDDLTQAVCDRAFIGEDKLPRNEKAFKEQIKRARSRLPAVKEALSRYLQETAAAYAELNGKLGKHPLTHLLRLRLQTLLAPGFATRTPWAQWPRLPIYLKAMTLRLEKYSSNPARDAAREADIQELEQMWQEKTDGLAKQGQPVSDGLAAFKWMIEELRVSLFAQELKTPYPVSVKRLLKMWEILL

SEQ ID NO: 7917 - DNA, 909 bp, Neisseria gonorrhoeae
atggttcatattatgtttaatcaggccgcacaagaattgacgactatccgtgatgttttacgttttgcagtcagccgttttaatgaggcagggctcttttttggtcatggaacagataatgcgcatgatgaagcggtttatttgattctgcatactttgaatttgcctttggatatgcttgccccatatcttgatgcaaaactcttggaagctgaaaaagaggaagtgctggcggttattgagcgtcgtgctgtcgaacacattcctgccgcttatttgacacaccaggcctggcagggggagtttgatttttatgtagatgaacgcgtgattgtaccgcgctcttttatttatgaattgctgggtgacggacttcgaccttggatagaatacgatgagctggtgcataatgctttggatctttgcaccggaagcggttgccttgccattcagatggcgcaccattatcctgatgcccaaattgatgcggttgatgtgagtttggatgctttggaagttgcagggatcaatattgaagattatggtctggaagagcgtattcagcttattcataccgatttgtttgagggactggaaggcacttatgatttgattgtttccaatccgccttatgtggatgcagagtcggttggggctttgcctgaggaatatttgcacgaaccggaattggcgttgggcagcggggcggacgggttggatgccaccaggcagattcttctgaatgcggcaaagtttctgaatcctaaaggtgtattgctggtggaaatcgggcataacagggatgtattggaagcagcgtatccggagttgccttttacttggttggaaaccagcgggggcgacggttttgttttcctcttgacgcgcgagcagttattgggcgaagag

SEQ ID NO: 7918 - protein, 303 aa, Neisseria gonorrhoeae
MVHIMFNQAAQELTTIRDVLRFAVSRFNEAGLFFGHGTDNAHDEAVYLILHTLNLPLDMLAPYLDAKLLEAEKEEVLAVIERRAVEHIPAAYLTHQAWQGEFDFYVDERVIVPRSFIYELLGDGLRPWIEYDELVHNALDLCTGSGCLAIQMAHHYPDAQIDAVDVSLDALEVAGINIEDYGLEERIQLIHTDLFEGLEGTYDLIVSNPPYVDAESVGALPEEYLHEPELALGSGADGLDATRQILLNAAKFLNPKGVLLVEIGHNRDVLEAAYPELPFTWLETSGGDGFVFLLTREQLLGEE

SEQ ID NO: 7919 - DNA, 120 bp, Neisseria gonorrhoeae
atgattccgttcggcaacagggtgaggcagggtaggggcggcagttttatgccgtctgaaagcctgtctttacgcttgtttgcaaaaatagtgggaaaaggaacatacaatcctgtacaa

SEQ ID NO: 7920 - protein, 40 aa, Neisseria gonorrhoeae
MIPFGNRVRQGRGGSFMPSESLSLRLFAKIVGKGTYNPVQ

SEQ ID NO: 7921 - DNA, 4131 bp, Neisseria gonorrhoeae
atggaagaagagtttgatgccatcaaaatcggtattgcctctcccgaaaccatccgctcatggtcttatggcgaagttaaaaaacctgaaaccatcaactaccgtacgttcaaacccgagcgcgacggcttgttctgcgccaaaatctttggcccggtcaaagactacgaatgcttgtgcggaaaatacaaacgattgaaatttaaaggcgtaacctgtgaaaaatgtggcgtagaagttaccctgtccaaagtgcgccgcgaacgcatgggccatatcgaattggctgcacccgttgcccatatttggttcttgaaatccctgccttcccgcttgggtatggtattgaacatgacgttgcgtgatatcgaacgcgtattgtactttgaagcattcgtggtgaccgatcccggcatgactccgttgcaacgtcgtcaattgctgactgaagacgattactacaacaaactggacgaatacggcgacgacttcgatgccaaaatgggtgcggaaggtatccgcgaattgttgcgaaccttggatgtagcaggcgaaatcgaaatcctgcgccaagagcttgaatcgaccggttctgacaccaaaatcaaaaaaatcgctaaacgcttgaaagtattggaagccttccatcgttccggtatgaagctggagtggatgattatggatgtgctgccggtattgccgcctgatttgcgtccgttggttccgttggacggcggccgttttgccacttccgatttgaacgatttgtaccgccgcgtcatcaaccgcaacaaccgtctgaaacgcctgctggaactgcatgcgcctgacatcatcgtccgcaacgaaaaacgtatgttgcaagaagcggttgattcgctgttggataacggccgtcgcggtaaagccatgaccggagccaacaaacgtccgctgaaatcgttggcagatatgattaaaggtaaaggcggccgcttccgtcaaaacctgttgggcaaacgtgtggactactccggccgttccgtgattaccgtaggcccatacctgcgtctgcaccaatgcggtttgccgaaaaaaatggcgttggaactgttcaaaccatttattttccacaaattggaaaaacaaggtttggcgtctaccgttaaagctgcgaaaaaattggtagaacaagaagtacctgaagtatgggatatcttggaagaagtcatccgcgaacatccgattatgttgaaccgtgcgccgaccctgcaccgtttgggtattcaagcgttcgagcctattctgatcgaaggtaaagcgattcagttgcacccattggtgtgtgccgcatttaatgccgactttgacggtgaccaaatggcagtacacgttccattgagcttggaagcgcaaatggaagcacgcacgctgatgctggcttcaaacaacgtattgtctcctgccaacggcgaaccgattatcgtaccttcccaagacatcgtattgggtctgtactacatgacccgcgaccgtatcaatgccaaaggcgagggcagcctgtttgccgatgtgaaagaagtgcatcgtgcataccataccaaacaggtcgagctgggtacaaaaatcaccgtacgtctgcgcgaatgggtgaaaaacgaagcaggtgagtttgagcctgtcgttaaccgttacgaaacaaccgtcggccgtgcattgttgagcgaaatcctgccgaaaggcctgccgtttgaatatgtcaacaaagcgttgaagaaaaaagaaatttccaagctgattaacgcatcgttccgcctgtgcggcttgcgcgatacggttatcttcgccgaccacctgatgtacaccggtttcggatttgcggcaaaaggcggtatttccattgccgttgacgatatggaaattccaaaagaaaaagcggccttgctggctgaagccaatgccgaagttaaagaaatcgaagaccaataccgtcaaggtttggttaccaacggcgaacgctacaacaaagtggtcgatatttggggtcgtgccggcgataagattgctaaagcgatgatggacaacctgtccaaacaaaaagttatcgaccgtgacggcaacgaagtcgatcaagagtcattcaactccatttatatgatggcggactccggtgcccgtggttctgcggctcagattaaacagttgtccggtatgcgcggtttgatggcgaaacctgacggatcgattattgaaacgccgattacctcaaacttccgcgaaggtctgaccgtattgcaatactttattgcgacccacggtgcgcgtaagggtttggcggataccgcgttgaaaaccgcgaactccggttacctgacccgtcgtctggtggatgtaactcaagacttggtcgttgttgaagacgattgcggtacttcagacggctttgtcatgaaggcagtggtacaaggcggtgatgtgattgaagcattgcgcgatcgtattttgggtcgtgttaccgcgtctgacgttgtcgatccgtcaagcggcgagactttggttgaagccggtacgttgttgactgaaaaactggtggatatgattgaccaatccggtgtcgatgaagtcaaagtccgtactccgattacttgtaaaacccgccacggtctgtgcgcgcactgttacggccgcgacttggcgcgcggcaaactggtcaatgccggcgaggcagtcggcgtgattgcggctcagtctattggtgaaccgggtacccagttgaccatgcgtacgttccacatcggtggtgcggcatcccgtgcggcagcagccagccaagtcgaagccaaatccaacggtacggcacgtttcagcagccaaatgcgttatgttgccaacaacaaaggcgagttggttgtcatcggccgttcttgcgaagtcgtgattcacgatgacatcggccgtgaacgcgaacgccacaaagtaccttacggtgccatcctgctggtacaagacggtatggccattaaagccggtcaaaccttggcaacttgggatccgcatacccgtccgatgattaccgaacatgcaggtatggtgaaattcgagaacatggaagagggcgttaccgttgcaaaacaaaccgatgatgtaaccggtttgtccactttggtagtgattgacggtaaacgccgttcctctagtgcttccaaactgctgcgtccgactgtgaaactcttggacgaaaacggcgtggaaatctgtattcccggtacgtccactccggtttcgatggcattccccgttggtgcggtgattaccgtacgcgaaggtcaggaaatcggtaaaggcgacgtattggcgcgtattccgcaagcctcttccaaaacccgcgacattaccggcggtctgccgcgcgttgccgagctgtttgaagcacgcgtgccgaaagatgccggtatgctggcggaaattaccggtaccgtttccttcggtaaggagaccaaaggcaaacaacgtctgattatcactgacgtggacggtgtagcatacgagactttgatttccaaagagaaacaaattctggtacatgacggtcaagtggtaaaccgaggcgaaaccattgtggacggcgcggtcgatccgcacgatattctgcgtctgcaaggtatcgaagcactggcacgctacattgtccaagaggtgcaagaggtttaccgcctgcaaggtgtgaagatttccgataaacacatcgaagtcatcatccgtcaaatgttgcgccgtgtgaacattgcggatgccggcgaaaccgggtttattaccggagagcaggtcgaacgcggcgatgtgatggcggccaatgaaaaagctttggaagaaggcaaagagccggcacgttacgaaaacatattgctgggtattaccaaagcctccctgtccaccgacagcttcatttctgccgcatcgttccaagaaaccacccgtgtgttgaccgaagctgccatcatgggcaaacaagacgaactgcgcggtctgaaagagaatgtcatcgtcggtcgcctgattcctgccggtaccggtttgacttatcaccgcagccgtcatcagcaatggcaaggggtagagcaggagactgctgaaacccaagtaacggatgaa

SEQ ID NO: 7922 - protein, 1377 aa, Neisseria gonorrhoeae
MEEEFDAIKIGIASPETIRSWSYGEVKKPETINYRTFKPERDGLFCAKIFGPVKDYECLCGKYKRLKFKGVTCEKCGVEVTLSKVRRERMGHIELAAPVAHIWFLKSLPSRLGMVLNMTLRDIERVLYFEAFVVTDPGMTPLQRRQLLTEDDYYNKLDEYGDDFDAKMGAEGIRELLRTLDVAGEIEILRQELESTGSDTKIKKIAKRLKVLEAFHRSGMKLEWMIMDVLPVLPPDLRPLVPLDGGRFATSDLNDLYRRVINRNNRLKRLLELHAPDIIVRNEKRMLQEAVDSLLDNGRRGKAMTGANKRPLKSLADMIKGKGGRFRQNLLGKRVDYSGRSVITVGPYLRLHQCGLPKKMALELFKPFIFHKLEKQGLASTVKAAKKLVEQEVPEVWDILEEVIREHPIMLNRAPTLHRLGIQAFEPILIEGKAIQLHPLVCAAFNADFDGDQMAVHVPLSLEAQMEARTLMLASNNVLSPANGEPIIVPSQDIVLGLYYMTRDRINAKGEGSLFADVKEVHRAYHTKQVELGTKITVRLREWVKNEAGEFEPVVNRYETTVGRALLSEILPKGLPFEYVNKALKKKEISKLINASFRLCGLRDTVIFADHLMYTGFGFAAKGGISIAVDDMEIPKEKAALLAEANAEVKEIEDQYRQGLVTNGERYNKVVDIWGRAGDKIAKAMMDNLSKQKVIDRDGNEVDQESFNSIYMMADSGARGSAAQIKQLSGMRGLMAKPDGSIIETPITSNFREGLTVLQYFIATHGARKGLADTALKTANSGYLTRRLVDVTQDLVVVEDDCGTSDGFVMKAVVQGGDVIEALRDRILGRVTASDVVDPSSGETLVEAGTLLTEKLVDMIDQSGVDEVKVRTPITCKTRHGLCAHCYGRDLARGKLVNAGEAVGVIAAQSIGEPGTQLTMRTFHIGGAASRAAAASQVEAKSNGTARFSSQMRYVANNKGELVVIGRSCEVVIHDDIGRERERHKVPYGAILLVQDGMAIKAGQTLATWDPHTRPMITEHAGMVKFENMEEGVTVAKQTDDVTGLSTLVVIDGKRRSSSASKLLRPTVKLLDENGVEICIPGTSTPVSMAFPVGAVITVREGQEIGKGDVLARIPQASSKTRDITGGLPRVAELFEARVPKDAGMLAEITGTVSFGKETKGKQRLIITDVDGVAYETLISKEKQILVHDGQVVNRGETIVDGAVDPHDILRLQGIEALARYIVQEVQEVYRLQGVKISDKHIEVIIRQMLRRVNIADAGETGFITGEQVERGDVMAANEKALEEGKEPARYENILLGITKASLSTDSFISAASFQETTRVLTEAAIMGKQDELRGLKENVIVGRLIPAGTGLTYHRSRHQQWQGVEQETAETQVTDE

SEQ ID NO: 7923 - DNA, 249 bp, Neisseria gonorrhoeae
ttgtgttcatcggtattcctaaaaccttttccgcccgccaagcggattgacgggcggcagatatggatgattttgattatctttataaattttattataaatcaattgtttatttctcattgtacaggattgtatgttccttttcccactatttttgcaaacaagcgtaaagacaggctttcagacggcataaaactgccgcccctaccctgcctcaccctgttgccgaacggaatcatccgtattttt

SEQ ID NO: 7924 - protein, 83 aa, Neisseria gonorrhoeae
LCSSVFLKPFPPAKRIDGRQIWMILIIFINFIINQLFISHCTGLYVPFPTIFANKRKDRLSDGIKLPPLPCLTLLPNGIIRIF

SEQ ID NO: 7925 - DNA, 249 bp, Neisseria gonorrhoeae
atggatattttccgtgaatcaaggccgttctgcgcgacaggctgtccaacgccaacatccggttcggcatttcatcatcgccgccgacgatacgggcaagaccgcatcggtcgtgccttcctaacgatgcaccgcatcctcgacaaggaaaaccagatacataccgatatggctttagcgttgccggcggtagtgaaagacgcagtggcgatatgggcagatatggatacattggataggtgttccggc

SEQ ID NO: 7926 - protein, 83 aa, Neisseria gonorrhoeae
MDIFRESRPFCATGCPTPTSGSAFHHRRRRYGQDRIGRAFLTMHRILDKENQIHTDMALALPAVVKDAVAIWADMDTLDRCSG

SEQ ID NO: 7927 - DNA, 108 bp, Neisseria gonorrhoeae
atgcctaaatcgcgcctgcctgaaatgctgttttttctaaagcatcacgaccttcacgaaaaatgccgtctgaagaatatttcagacggcattccctccctgaggcaa

SEQ ID NO: 7928 - protein, 36 aa, Neisseria gonorrhoeae
MPKSRLPEMLFFLKHHDLHEKCRLKNISDGIPSLRQ

SEQ ID NO: 7929 - DNA, 4182 bp, Neisseria gonorrhoeae
gtgtgtatgaactattcgtttaccgagaaaaaacgtatccgtaagagttttgcaaagcgggaaaatgttttggaagttccttttctactggcaacccaaattgattcttatgcgaaatttttgcagctggaaaatgcttttgacaaacgtaccgatgacggtctgcaagcggcatttaattctattttcccgattgtgagccacaacggttatgctcgtctggagtttgtatattacacgctgggcgagcctttgttcgatatccctgaatgtcaattgcgcggaatcacttatgctgcccctctgcgcgcgcgtatccgtttggtgattttggataaggaagcgtctaaaccgacggtaaaagaagttcgtgaaaacgaagtgtatatgggcgaaattccgttgatgaccccgagcggttcttttgtgattaacggcacagagcgtgtgattgtttcccagttgcaccgttcgcccggtgtgttcttcgagcatgacaaaggtaagacacactcttccggcaaattgttattctccgcccgcatcattccctaccgtggttcatggttggattttgaatttgatccgaaagatttgctgtatttccgtatcgaccgccgccgtaaaatgccggtaacgattttgttgaaggctttgggctacaacaatgagcaaatcttggatattttctacgacaaagaaacgttttatttgtcttcaaacggtgttcaaaccgatttggtcgcaggccgtctgaaaggcgaaactgccaaggtcgatatcttggataaagaaggcaatgtattggttgccaaaggtaagcgcattactgcgaaaaatatccgtgatattaccaatgcaggcctgacccgtttggatgtagaacaggaaagcctgctgggcaaagcattggctgccgatttgattgattcggaaaccggcgaggtattggcttctgccaatgatgaaattacagaagagttgttggccaaatttgatattaacggcgtaaaagaaattacgaccctttacatcaatgagttggatcagggtgcttatatttccaataccttgcgcacggatgagactgccggccggcaggcggcgcgtgttgcgatttaccgtatgatgcgtccgggcgaaccgcccaccgaagaggcggtcgagcaattgtttaaccgcttgttcttcagtgaagacagctacgatttgtcccgcgtaggccgtatgaaatttaatacgcgcacatacgaacaaaaactgtccgaagcccaacaaaactcttggtacggccgcctgttgaacgagacgtttgccggtgctgccgacaaaggcggttatgtcctgagcgtcgaagatattgtcgcctcgattgcgactttggtcgagttgcgtaacggccatggcgaagtggacgatatcgatcacttgggcaaccgtcgagtacggtcggtaggcgagctgactgaaaaccaattccgcagcggtttggctcgtgtggaacgtgccgtaaaagaacgtttgaatcaggcggaatcagaaaacttgatgccgcacgacttgattaatgcgaaacccgtttctgccgccatcaaagaattcttcggctccagccaattgagtcagtttatggatcagaccaatcccttgtctgaagtaacccataaacgccgtgtatctgcattgggtccgggcggtttgacccgcgaacgtgccggcttcgaagtgcgggacgtgcatccgacccactatggacgtgtatgtcctattgaaacgcctgaaggtccgaacatcggtttgatcaactcattgtctgtttacgcgcgcaccaatgattacggtttcttggaaacgccttaccgccgcgttattgacggcaaagtaaccgaggaaattgattacttgtctgccatcgaagaaggccgctatgtgattgcacaggcgaatgccgatttggattcagacggcaatctgattggcgatttggttacctgtcgtgaaaaaggcgaaaccattatggcaacgcccgaccgcgtccaatatatggacgtggcaaccggtcaggtggtatccgttgcggcatccctgattccgttcttggaacacgatgacgcgaaccgcgcattgatgggtgccaacatgcaacgtcaggcagtgccttgtctgcgtcctgaaaaaccgatggtcggtaccggtatcgagcgttccgttgccgttgactctgctactgcaatcgttgcccgccgaggcggcgtggtcgagtatgtcgatgccaaccgcgttgtgatccgtgtccatgacgacgaagcgactgccggtgaagtgggtgtcgatatttacaatttggttaaattcacccgttccaatcaatctaccaacatcaaccaacgtccggctgtcaaagcaggcgatgttttgcaacgcggcgatttggtggccgacggcgcgtccaccgatttgggcgaattggctttgggtcaaaatatgaccatcgccttcatgccgtggaacggttacaactacgaagactcgattctgatttccgaaaaagtggctgcggacgaccgctatacttcgattcacattgaggaattgaatgtcgttgcccgcgataccaagctgggtgcggaagacattacccgcgatattccgaacttgtccgagcgtatgcaaaaccgtttggacgaatccggtatcgtttacatcggtgcggaagtagaagccggcgatgtgttggtaggcaaggtaacgcctaaaggcgaaacccagctgacgccggaagaaaaactgctgcgcgccatcttcggcgaaaaagcgtctgacgtaaaagatacttcattgcgtatgcctaccggtatgagcggtacggttatcgacgttcaagtctttacccgcgaaggcatccaacgcgacaaacgcgcccaatccattatcgattccgagttgaaacgctaccgtttggatttgaacgaccaattgcgtattttcgacaacgacgcattcgaccgtatcgagcgtatgattgtcggtcagaaagccaacggcggcccgatgaagctgaccaaaggcagcgaaatcacgaccgaatatctggcgggtctgccgagcaggcacgattggttcgatatccgtttgaccgatgaagatttggccaagcagttggaactgattaaattgagcctgcaacaaaaacgcgaagaagcggatgagttgtatgagatcaagaagaaaaaactgacccaaggcgacgagctgcaacccggcgtacaaaaaatggtgaaagtctttatcgccatcaaacgccgtctgcaagccggtgacaaaatggcgggccgccacggtaataaaggtgtggtatctcgcattctgcctgtggaagacatgccgtacatggcggacggccgtcctgtggacatcgtactgaacccgttgggcgtaccttcccgtatgaacatcggtcagattttggaagttcacttgggttgggcggcaaaaggtatcggcgagcgcatcgaccgtatgctgaaagagcgacgcaaagccggcgagctgcgcgagttcttgaacaaactctacaacggcagcggtaagaaagaagatttggacagcctgactgatgaagaaatcatcgaattggcttccaatctgcgtaaaggtgcatctttcgcctctcctgtattcgacggtgcgaaagagtctgaaatccgcgaaatgttgaacttggcttacccaagcgaagatcctgaggttgagaaactgggcttcaacgacagtaaaactcaaatcacgctgtatgacggccgttcaggcgaagcatttgaccgcaaggttacagtcggtgtgatgcactatctgaaactgcaccacttggttgacgaaaaaatgcacgcgcgttctaccggcccgtacagtctggttactcaacaacctctgggcggtaaagctcagtttggcggccaacgtttcggtgagatggaggtttgggcattggaagcatacggcgcggcatacacgctgcaagagatgctgactgtgaagtctgacgacgtgaacggccgtaccaaaatgtacgaaaacatcgtcaaaggcgaacacaaaatcgatgccggtatgcccgagtccttcaacgtattggtcaaagagattcgctcactgggtttggatatcgatttggaacgctac

SEQ ID NO: 7930 - protein, 1394 aa, Neisseria gonorrhoeae
VCMNYSFTEKKRIRKSFAKRENVLEVPFLLATQIDSYAKFLQLENAFDKRTDDGLQAAFNSIFPIVSHNGYARLEFVYYTLGEPLFDIPECQLRGITYAAPLRARIRLVILDKEASKPTVKEVRENEVYMGEIPLMTPSGSFVINGTERVIVSQLHRSPGVFFEHDKGKTHSSGKLLFSARIIPYRGSWLDFEFDPKDLLYFRIDRRRKMPVTILLKALGYNNEQILDIFYDKETFYLSSNGVQTDLVAGRLKGETAKVDILDKEGNVLVAKGKRITAKNIRDITNAGLTRLDVEQESLLGKALAADLIDSETGEVLASANDEITEELLAKFDINGVKEITTLYINELDQGAYISNTLRTDETAGRQAARVAIYRMMRPGEPPTEEAVEQLFNRLFFSEDSYDLSRVGRMKFNTRTYEQKLSEAQQNSWYGRLLNETFAGAADKGGYVLSVEDIVASIATLVELRNGHGEVDDIDHLGNRRVRSVGELTENQFRSGLARVERAVKERLNQAESENLMPHDLINAKPVSAAIKEFFGSSQLSQFMDQTNPLSEVTHKRRVSALGPGGLTRERAGFEVRDVHPTHYGRVCPIETPEGPNIGLINSLSVYARTNDYGFLETPYRRVIDGKVTEEIDYLSAIEEGRYVIAQANADLDSDGNLIGDLVTCREKGETIMATPDRVQYMDVATGQVVSVAASLIPFLEHDDANRALMGANMQRQAVPCLRPEKPMVGTGIERSVAVDSATAIVARRGGVVEYVDANRVVIRVHDDEATAGEVGVDIYNLVKFTRSNQSTNINQRPAVKAGDVLQRGDLVADGASTDLGELALGQNMTIAFMPWNGYNYEDSILISEKVAADDRYTSIHIEELNVVARDTKLGAEDITRDIPNLSERMQNRLDESGIVYIGAEVEAGDVLVGKVTPKGETQLTPEEKLLRAIFGEKASDVKDTSLRMPTGMSGTVIDVQVFTREGIQRDKRAQSIIDSELKRYRLDLNDQLRIFDNDAFDRIERMIVGQKANGGPMKLTKGSEITTEYLAGLPSRHDWFDIRLTDEDLAKQLELIKLSLQQKREEADELYEIKKKKLTQGDELQPGVQKMVKVFIAIKRRLQAGDKMAGRHGNKGVVSRILPVEDMPYMADGRPVDIVLNPLGVPSRMNIGQILEVHLGWAAKGIGERIDRMLKERRKAGELREFLNKLYNGSGKKEDLDSLTDEEIIELASNLRKGASFASPVFDGAKESEIREMLNLAYPSEDPEVEKLGFNDSKTQITLYDGRSGEAFDRKVTVGVMHYLKLHHLVDEKMHARSTGPYSLVTQQPLGGKAQFGGQRFGEMEVWALEAYGAAYTLQEMLTVKSDDVNGRTKMYENIVKGEHKIDAGMPESFNVLVKEIRSLGLDIDLERY

SEQ ID NO: 7931 - DNA, 138 bp, Neisseria gonorrhoeae
atgtcaggtaaggaaccgcttaaccgtaatccggttattgcctcagggagggaatgccgtctgaaatattcttcagacggcatttttcgtgaaggtcgtgatgctttagaaaaaacagcatttcaggcaggcgcgatt

SEQ ID NO: 7932 - protein, 46 aa, Neisseria gonorrhoeae
MSGKEPLNRNPVIASGRECRLKYSSDGIFREGRDALEKTAFQAGAI

SEQ ID NO: 7933 - DNA, 120 bp, Neisseria gonorrhoeae
ttgtttacatttatttgcatagtttttatcaaatcattgcaaataaatgtaaatatcagattgatgcgtaccgttgttttcagacggcctattattgaaaattacttttcggagtgtgta

SEQ ID NO: 7934 - protein, 40 aa, Neisseria gonorrhoeae
LFTFICIVFIKSLQINVNIRLMRTVVFRRPIIENYFSECV

SEQ ID NO: 7935 - DNA, 369 bp, Neisseria gonorrhoeae
atggctattactaaagaagacattttggaagcagttggttctttgaccgtaatggaattgaatgacctggttaaagcttttgaagaaaaattcggtgtttctgctgctgctgttgcagttgcaggtcctgctggtgccggtgctgccgatgctgaagaaaaaaccgaatttgatgtcgttttggcttctgccggcgatcaaaaagtcggcgtgattaaagttgtccgtgcaattactggtttgggtctgaaagaagctaaagacatcgttgacggcgcacctaaaaccattaaagagggtgtttctaaagctgaagccgaagacatccaaaaacaactggaagcagcaggcgctaaagtcgaaatcaaa

SEQ ID NO: 7936 - protein, 123 aa, Neisseria gonorrhoeae
MAITKEDILEAVGSLTVMELNDLVKAFEEKFGVSAAAVAVAGPAGAGAADAEEKTEFDVVLASAGDQKVGVIKVVRAITGLGLKEAKDIVDGAPKTIKEGVSKAEAEDIQKQLEAAGAKVEIK

SEQ ID NO: 7937 - DNA, 360 bp, Neisseria gonorrhoeae; identical to SEQ ID NO: 6981

SEQ ID NO: 7938 - protein, 120 aa, Neisseria gonorrhoeae; identical to SEQ ID NO: 6982

SEQ ID NO: 7939 - DNA, 933 bp, Neisseria gonorrhoeae
atgaagttttgccccatcggtgcaacatcaatcttttttaacaaaggaaaccccatgccgtctgaaaaccccctctttgccctgcccgacaccttgttgcgccccatggtggaacaagccttgagcgaagacttgggcaggcgcggcgacattacgtccgccgccgtcatcgcgcccgacaaaaccgccaaacttttcctcgtcagccgcgaagacggtgttatcgccggtatggacttggcgcgcctcgcctttcagacgatggatccgtgcgtccgcttccaagccgaaatccaagacgggcaagccgtccgcgcaggtcagacactggctgccgtcgaaggcaacgcccgcgcgctgctcgccgccgaacgcaccgcgctcaactacctcacgcacttgagcggcatcgccaccgccaccgctcgtgccgttgccgaggtcgccgaatacggtacagacatcgtgtgcagccgcaaaaccatccccctgctgcgcgtcctgcaaaaatacgccgtcagggcgggcggcggcgcgaaccaccgcatgggtttggacgacgccgtgctcatcaaagacaaccacctcgcctattgcggcagcatcgcccaagccgttcggcaggcaaaacaggcggtcggaccgttgacctgcgtggaaatcgaagtggacacgttggcacaactggacgaagccatcgcagcgggcgcggaacggattttgctggacaacatggacgacgaaaccctgaaagaagcggcaaaccgctgccacacacaaaccgcccacccacacaccgtctattgcgaagcatcgggcggcatcggcttcgaccgcctgaagcgcgtggcgcaaaccggcgtggacggcatcgccctcggctatctgacccacagcagccgatcgttggacataggtttggatttcgtggcg

SEQ ID NO: 7940 - protein, 311 aa, Neisseria gonorrhoeae
MKFCPIGATSIFFNKGNPMPSENPLFALPDTLLRPMVEQALSEDLGRRGDITSAAVIAPDKTAKLFLVSREDGVIAGMDLARLAFQTMDPCVRFQAEIQDGQAVRAGQTLAAVEGNARALLAAERTALNYLTHLSGIATATARAVAEVAEYGTDIVCSRKTIPLLRVLQKYAVRAGGGANHRMGLDDAVLIKDNHLAYCGSIAQAVRQAKQAVGPLTCVEIEVDTLAQLDEAIAAGAERILLDNMDDETLKEAANRCHTQTAHPHTVYCEASGGIGFDRLKRVAQTGVDGIALGYLTHSSRSLDIGLDFVA

SEQ ID NO: 7941 - DNA, 498 bp, Neisseria gonorrhoeae
ttgagtctcaatattgaaaccaagaaagtggcggtcgaggaaattagcgcggcaattgctaatgctcaaaccctcgtagtcgctgaatatcgcggtatcagtgtttccagtatgactgagcttcgtgcgaatgcacgtaaagaaggcgtttatttgcgcgttctgaaaaatactctggctcgtcgcgcagtgcaaggtacttcatttgtagaattggccgatcaaatggttggtccgttggtttacgctgcttctgaagatgctgttgctgctgctaaagtgttgcaccaattcgcgaaaaaagatgacaaaattgtcgttaaagccggttcttacaatggcgaagtaatgaatgctgctcaggttgctgagttggcttctattccgagccgcgaagagctgttgtccaaactgttgttcgttatgcaagctcctgtatcgggctttgcgcgcggtttggctgctttggcagagaaaaaagccggcgaagaagctgct

SEQ ID NO: 7942 - protein, 166 aa, Neisseria gonorrhoeae
LSLNIETKKVAVEEISAAIANAQTLVVAEYRGISVSSMTELRANARKEGVYLRVLKNTLARRAVQGTSFVELADQMVGPLVYAASEDAVAAAKVLHQFAKKDDKIVVKAGSYNGEVMNAAQVAELASIPSREELLSKLLFVMQAPVSGFARGLAALAEKKAGEEAA

SEQ ID NO: 7943 - DNA, 876 bp, Neisseria gonorrhoeae
ttgattgccgttaccgacggcggcctgcgggtgttgaccgtcgcccaaggcacgctcctgcccaacggcccgctttcccccctgcgcaattccctgcaggcgggcgtaaagctgtgggtcgccaagcagacttcgcagcctatgggctatgtggaacagctttacacctttgtcgatacccaccgccgcaacgaacacggcatgcccgtgctgtacgtcagctatttggggctggtgcgcgaggcagccgatagcatcctgcatcccgacgcgaaatggcaggactgctacggctatttcccatgggaagacttgcgcaccgacggcgggcagcgcgacgccgtcgtcagccgcctgcgcatttgggcaaactcggcggacacggaggaagtccgccaaaagcggctcaagcatattcatttgtgttggggggtcgaaccggaaaactggtcggaagaatacgttttgcaacgctatgaaatgttgtatgaaagcggtctgatagcggaggccgccgagccgcaggcaaacttcgacttcgcgctcacggggcagaccatgcgccacgaccaccgccgcgtgttggcgaccgccctgtcccgcctgcgcgccaaaatcaaataccgccccgtgattttcgaactgatgccgcccggatttacactgctgcaactgcaaaacagcgtcgaagccatcagcggcagattgctgcacaagcaaaacttccgccgccagattcagcagcaaaaccttatcgagccgtcggataccggcgtatcgggcagcaaaggccgtcccgcgcagctttaccgcttccgcgacaacgtcctgtccgacaggctgatttcggacatcggactgccgctgggcagccgt

SEQ ID NO: 7944 - protein, 292 aa, Neisseria gonorrhoeae
LIAVTDGGLRVLTVAQGTLLPNGPLSPLRNSLQAGVKLWVAKQTSQPMGYVEQLYTFVDTHRRNEHGMPVLYVSYLGLVREAADSILHPDAKWQDCYGYFPWEDLRTDGGQRDAVVSRLRIWANSADTEEVRQKRLKHIHLCWGVEPENWSEEYVLQRYEMLYESGLIAEAAEPQANFDFALTGQTMRHDHRRVLATALSRLRAKIKYRPVIFELMPPGFTLLQLQNSVEAISGRLLHKQNFRRQIQQQNLIEPSDTGVSGSKGRPAQLYRFRDNVLSDRLISDIGLPLGSR

SEQ ID NO: 7945 - DNA, 1083 bp, Neisseria gonorrhoeae
ttgatgccgtctgaaaacgggctaacggctgcccagcggcagtccgatgtccgaaatcagcctgtcggacaggacgttgtcgcggaagcggtaaagctgcgcgggacggcctttgctgcccgatacgccggtatccgacggctcgataaggttttgctgctgaatctggcggcggaagttttgcttgtgcagcaatctgccgctgatggcttcgacgctgttttgcagttgcagcagtgtaaatccgggcggcatcagttcgaaaatcacggggcggtatttgattttggcgcgcaggcgggacagggcggtcgccaacacgcggcggtggtcgtggcgcatggtctgccccgtgagcgcgaagtcgaagtttgcctgcggctcggcggcctccgctatcagaccgctttcatacaacatttcatagcgttgcaaaacgtattcttccgaccagttttccggttcgaccccccaacacaaatgaatatgcttgagccgcttttggcggacttcctccgtgtccgccgagtttgcccaaatgcgcaggcggctgacgacggcgtcgcgctgcccgccgtcggtgcgcaagtcttcccatgggaaatagccgtagcagtcctgccatttcgcgtcgggatgcaggatgctatcggctgcctcgcgcaccagccccaaatagctgacgtacagcacgggcatgccgtgttcgttgcggcggtgggtatcgacaaaggtgtaaagctgttccacatagcccataggctgcgaagtctgcttggcgacccacagctttacgcccgcctgcagggaattgcgcaggggggaaagcgggccgttgggcaggagcgtgccttgggcgacggtcaacacccgcaggccgccgtcggtaacggcaatcaatacgggaaccagctcgacgatgctttgcagcggagcttcggcttcggggtaggcgtccatgctcggctttctgcgggtgggaaaggctttattgtaaaccaaagcggtttgtcggaacgaagcgggtcggttttgcggtatcgcaaacctgttttcagacgaccttgcatattatactcaagt

SEQ ID NO: 7946 - protein, 361 aa, Neisseria gonorrhoeae
LMPSENGLTAAQRQSDVRNQPVGQDVVAEAVKLRGTAFAARYAGIRRLDKVLLLNLAAEVLLVQQSAADGFDAVLQLQQCKSGRHQFENHGAVFDFGAQAGQGGRQHAAVVVAHGLPREREVEVCLRLGGLRYQTAFIQHFIALQNVFFRPVFRFDPPTQMNMLEPLLADFLRVRRVCPNAQAADDGVALPAVGAQVFPWEIAVAVLPFRVGMQDAIGCLAHQPQIADVQHGHAVFVAAVGIDKGVKLFHIAHRLRSLLGDPQLYARLQGIAQGGKRAVGQERALGDGQHPQAAVGNGNQYGNQLDDALQRSFGFGVGVHARLSAGGKGFIVNQSGLSERSGSVLRYRKPVFRRPCILYSS

SEQ ID NO: 7947 - DNA, 693 bp, Neisseria gonorrhoeae
atggctaaagtatctaaacgcttgaaagttcttcgctcttctgttgaagctaacaaactgtacgcaatcgacgaagcaattgccttggttaaaaaagctgctaccgctaaatttgacgaatctgttgacgtatctttcaacttgggcgttgattctcgtaaatctgaccaagttatccgtggttcagtcgttctgcctaaaggtactggtaagacaacccgtgtggctgtatttactcaaggtgtaaatgcagaagctgctaaagaggctggtgcggatgtcgtcggtttcgaagatttggctgctgaaatcaaagcaggcaatctgaactttgatgttgttattgcttctcctgatgcaatgcgtatcgttggtcaattgggtaccatcttgggtcctcgtggtctgatgccaaaccctaaaataggtacggttacccctaatgttgccgaagcggtaaaaaatgcaaaagcaggtcaagtgcagtaccgtaccgacaaggcaggtattgttcatgcaacgattggtcgtgcttcattcgctgaagctgatttgaaagagaactttgatgcgttgctggacgctatcgttaaagccaaacctgctgctgctaaaggtcagtacctgaaaaaagttgctgtatccagcactatgggtttaggtgttcgcgttgatacatcaagcgtgaataac

SEQ ID NO: 7948 - protein, 231 aa, Neisseria gonorrhoeae
MAKVSKRLKVLRSSVEANKLYAIDEAIALVKKAATAKFDESVDVSFNLGVDSRKSDQVIRGSVVLPKGTGKTTRVAVFTQGVNAEAAKEAGADVVGFEDLAAEIKAGNLNFDVVIASPDAMRIVGQLGTILGPRGLMPNPKIGTVTPNVAEAVKNAKAGQVQYRTDKAGIVHATIGRASFAEADLKENFDALLDAIVKAKPAAAKGQYLKKVAVSSTMGLGVRVDTSSVNN

SEQ ID NO: 7949 - DNA, 393 bp, Neisseria gonorrhoeae
atgggcaacctgataggctgggaaggaacggggctggttgccggcaagcagtggataaccgcaaaagacgacaaggtgtccgatgtctgcaatgccaacggcgggatgggcgtaatcggtttgcacgagcctttctcccacggtgcgttgacgataccggagcatccaaatggcaggtgcgcggttgttcccgttgtcgggcggacaggcaagctggcgaaaggcagccgcgcgatggaaacgggcgatggacggcaggtgaggttgtttccgtatcgggcggcgaattgggggaatttgctgaaacaaaggagcttcgtaaagcggctatgcagtatgcgcgtgataactttgtcggcaaaagctatgtcaatgaaagcagcgggcatgaac

SEQ ID NO: 7950 - protein, 131 aa, Neisseria gonorrhoeae
MGNLIGWEGTGLVAGKQWITAKDDKVSDVCNANGGMGVIGLHEPFSHGALTIPEHPNGRCAVVPVVGRTGKLAKGSRAMETGDGRQVRLFPYRAANWGNLLKQRSFVKRLCSMRVITLSAKAMSMKAAGMN

SEQ ID NO: 7951 - DNA, 261 bp, Neisseria gonorrhoeae
atgtttccttgtagctggttttcagacggcatgaaggtttgccgtctgtttttcaaactgtttttacattatgctcaacttgagtataatatgcaaggtcgtctgaaaacaggtttgcgataccgcaaaaccgacccgcttcgttccgacaaaccgctttggtttacaataaagcctttcccacccgcagaaagccgagcatggacgcctaccccgaagccgaagctccgctgcaaagcatcgtcgagctggttcccgtat

SEQ ID NO: 7952 - protein, 87 aa, Neisseria gonorrhoeae
MFPCSWFSDGMKVCRLFFKLFLHYAQLEYNMQGRLKTGLRYRKTDPLRSDKPLWFTIKPFPPAESRAWTPTPKPKLRCKASSSWFPY

SEQ ID NO: 7953 - DNA, 1110 bp, Neisseria gonorrhoeae
atgcaaaccgccgcccgccgctcgttcgattacgatatgcccctcatccaaacgccgacttccgcctgccaaatccgtcaggcgtgggcgaaggttgccgacacgcccgaccacgagacggcaggtcgtctgaaagacgaaatcaaggtcttgctgaagcggaaaaacgcggtcttggtggcgcattattacgtcgatccgctgattcaggatttggctttggagacgggcggatgcgtgggcgattcgctggaaatggcgcgcttcggcgcggaacacgaagccggtacgctggtggtggcgggcgtgcgtttcatgggcgagagcgcgaaaatcctctgccctgaaaaaacggtgctgatgcctgatttggaagcggaatgttctttggatttgggttgtcccgaagaagcgttttcagcgttttgcgaccaacaccccgaccgcacggtggcggtgtacgccaatacttccgcagccgtgaaagcgcgtgccgactgggtggtaacgtcttcggtggcgttggaaatcgtgtcgtatctgaaatcgcgcggcgagaaactgatttggggacccgaccgccacctcggcgactacatccgccgcgaaacgggcgcggatatgctgttgtggcagggttcgtgcatcgtccataacgaattcaaagggcaggaactggcggcgttgaaggcagagcatcccgatgctgtggtgctggttcatcccgaatcgccgcaaagcgtcatcgaactgggcgacgtggtcggctcgaccagcaaactactcaaagccgccgtatcgcgccctgaaaaaaaattcatcgtggcaaccgatttgggcatcctgcacgaaatgcaaaagcaggcgcccgacaaagaatttatcgccgcgccgacggcgggcaacggcggaagctgtaaaagctgcgcgttctgcccgtggatggcgatgaattcgctgggcggcatcaaacacgccctgacaggcggacgcaacgaaatcctgttggacagaaagctgggcgaagccgccaaactgcctttgcagcgtatgctcgacttcgcggcaggactcaaacgcggggatgtgttcaacggcatggggcccgcc

SEQ ID NO: 7954 - protein, 370 aa, Neisseria gonorrhoeae
MQTAARRSFDYDMPLIQTPTSACQIRQAWAKVADTPDHETAGRLKDEIKVLLKRKNAVLVAHYYVDPLIQDLALETGGCVGDSLEMARFGAEHEAGTLVVAGVRFMGESAKILCPEKTVLMPDLEAECSLDLGCPEEAFSAFCDQHPDRTVAVYANTSAAVKARADWVVTSSVALEIVSYLKSRGEKLIWGPDRHLGDYIRRETGADMLLWQGSCIVHNEFKGQELAALKAEHPDAVVLVHPESPQSVIELGDVVGSTSKLLKAAVSRPEKKFIVATDLGILHEMQKQAPDKEFIAAPTAGNGGSCKSCAFCPWMAMNSLGGIKHALTGGRNEILLDRKLGEAAKLPLQRMLDFAAGLKRGDVFNGMGPA

SEQ ID NO: 7955 - DNA, 432 bp, Neisseria gonorrhoeae
gtggcaaagaaaattatcggctatattaaactgcaaattcctgcaggcaaagccaatccatcccccccagttggtcctgctttgggtcaacgtggtttgaatatcatggaattctgtaaagcatttaatgctgcaacccaaggtatggaatctggtttgccaattccggttgtgattactgcatttgcagataaatcattcacatttgtgatgaaaactcctccggcttctattctgttgaaaaaagccgccggtttgcaaaaaggtagttctaatcctctgacaaacaaggtaggtaaattgacccgtgcccagttggaagaaattgctaaaactaaagagcctgatttgactgctgctgacttggatgcggctgttcgtactatagcaggttctgctcgctcaatgggcttggacgtggagggtgttgta

SEQ ID NO: 7956 - protein, 144 aa, Neisseria gonorrhoeae
VAKKIIGYIKLQIPAGKANPSPPVGPALGQRGLNIMEFCKAFNAATQGMESGLPIPVVITAFADKSFTFVMKTPPASILLKKAAGLQKGSSNPLTNKVGKLTRAQLEEIAKTKEPDLTAADLDAAVRTIAGSARSMGLDVEGVV

SEQ ID NO: 7957 - DNA, 534 bp, Neisseria gonorrhoeae
atgtcgaaaaaatggtatgttgtacaggcgtattcggggtttgagaagaatgtccaacgaatattggaagagcgaattgcccgtgaggagatgggagattatttcggacaaattctggtgcctgtagagaaagttgttgatatccgcaatggtcgtaagactattagtgaaagaaagtcatatcctggttatgtgttagttgagatggaaatgacagatgactcttggcatcttgtaaaaagcactccccgtgtttctggttttattggagggagggctaatagacccacgccgattagtcagagagaggctgaaattattttacagcaggttcagaccggcatagagaagccgaaaccaaaagttgaatttgaggtcggtcaacaggttcgtgtaaatgaaggaccgtttgcggattttaacggggtggttgaggaggtcaattatgaacggaataagttacgcgtgtctgttcagatatttggtagagaaacacccgttgagctggagttcagccaggttgagaagattaac

SEQ ID NO: 7958 - protein, 178 aa, Neisseria gonorrhoeae
MSKKWYVVQAYSGFEKNVQRILEERIAREEMGDYFGQILVPVEKVVDIRNGRKTISERKSYPGYVLVEMEMTDDSWHLVKSTPRVSGFIGGRANRPTPISQREAEIILQQVQTGIEKPKPKVEFEVGQQVRVNEGPFADFNGVVEEVNYERNKLRVSVQIFGRETPVELEFSQVEKIN

SEQ ID NO: 7959 - DNA, 276 bp, Neisseria gonorrhoeae
atgacagaacatacgcctgaaaaaaagaatgttaaagtgaatcaactggttgttcaagataaagaatctgcatctaattccggtaaggagggtttttttgcatatttctcaaattcttggtccgaattcaaaaaggtggtttggcctaagcgtgaagatgccgtcagaatgactgtatttgttatagtgtttgttgctgtgctttctatatttatctatgcggcagatacagcaatttcgtggttattttttgatgtattgctgagaagggaaggt

SEQ ID NO: 7960 - protein, 92 aa, Neisseria gonorrhoeae
MTEHTPEKKNVKVNQLVVQDKESASNSGKEGFFAYFSNSWSEFKKVVWPKREDAVRMTVFVIVFVAVLSIFIYAADTAISWLFFDVLLRREG

SEQ ID NO: 7961 - DNA, 1506 bp, Neisseria gonorrhoeae
atgcaaaccgattgcgacgtattgattgccggaaacgggctggcggcactgacgctcgccctgtcgctgcctgaatcgttccgcatcgtcattttgtgcaaaaaccggctggacgacaccgccagccgtcatgcgcaaggcgggattgcggcggcgtggtcgggagaggacgacatcggaaaacacgtcgccgatactttggaagcgggcgcaggtttgtgcgacgaagccgccgtccgcaccatcctgtcgcagggcaaaccggcaatcgaatggctgctggcgcagggcgtggcgttcgaccggaatcataacgacctgcacctgacgcgcgaaggcgggcatacctgccgccgaatcgcccacgtcgccgactacacgggcgaagccgtcatgcagagcctgattatccaaatacgccgccgaccgaacatccgcgtttacgagcggcagatggcgttggacgttcaaaccgaatcaggcgcagcgtgcggactgaccgtcctcgactgccgaacgcaagaaacctaccgcatccgtgcccgccataccgtactcgcaggcggcggcctcgggcaaatttacgccgccaccaccacgccgcccgaatgcacgggcgacgccatcgccatggcgatacgcgcgggttgcgcaatcgaaaacctcgaatttatccaattccaccccacaggcttggcaaggccgtctgaaaacggccgcaccttcctgatttccgaagccgtgcgcggcgaaggcggcatcctgaccaatcaatcgggcgaacggtttatgccgcattacgaccgccgcgccgaactcgcgccgcgcgacatcgttgcccgcgccatcgccgccgaaaccgccaaacaaacgcaagacttcgtctcgctcgacatcagccgccaacccgcagcgttcgtccgtcggcatttcccgtccatccatcggcactgcctgtcccaatgcggcttggacatcacgcgccaagccatccccgtccgccccgtgcaacactacacctgcggcggcatccaaaccgaccccagcggcagaacctccctgccgcagctctacgccttaggcgaaaccgcctgtaccggactgcacggagccaaccgcctcgccagcaactccctgctcgaatgcgtcgttaccgccaggcttgccgcccaaggcatcgcggacggacaagcgttccaaatcgaaccattccaaaggccgtctgaaagcccctccgccgaaacagacatcttttcaaacgacctccaaaacacattcagccgccctgtcctgcaaacgttcaaccaacgccatctcggcatcctccgcaacgataccgacctgcaccgcgccatcgaccaactgcggctttggaagcaaaaccaagccgaaccgcacaccgcgtccgaatacgaaaaccgcaacctactcgaatgcagcctcgccgtcgcccaagccgcatacaggcggagacagaacatcggtgcgcattttaatagtgattgt

SEQ ID NO: 7962 - protein, 502 aa, Neisseria gonorrhoeae
MQTDCDVLIAGNGLAALTLALSLPESFRIVILCKNRLDDTASRHAQGGIAAAWSGEDDIGKHVADTLEAGAGLCDEAAVRTILSQGKPAIEWLLAQGVAFDRNHNDLHLTREGGHTCRRIAHVADYTGEAVMQSLIIQIRRRPNIRVYERQMALDVQTESGAACGLTVLDCRTQETYRIRARHTVLAGGGLGQIYAATTTPPECTGDAIAMAIRAGCAIENLEFIQFHPTGLARPSENGRTFLISEAVRGEGGILTNQSGERFMPHYDRRAELAPRDIVARAIAAETAKQTQDFVSLDISRQPAAFVRRHFPSIHRHCLSQCGLDITRQAIPVRPVQHYTCGGIQTDPSGRTSLPQLYALGETACTGLHGANRLASNSLLECVVTARLAAQGIADGQAFQIEPFQRPSESPSAETDIFSNDLQNTFSRPVLQTFNQRHLGILRNDTDLHRAIDQLRLWKQNQAEPHTASEYENRNLLECSLAVAQAAYRRRQNIGAHFNSDC

SEQ ID NO: 7963 - DNA, 1098 bp, Neisseria gonorrhoeae; identical to SEQ ID NO: 7023

SEQ ID NO: 7964 - protein, 366 aa, Neisseria gonorrhoeae; identical to SEQ ID NO: 7024

SEQ ID NO: 7965 - DNA, 1182 bp, Neisseria gonorrhoeae
atggctaaggaaaaattcgaacgtagcaaaccgcacgtaaacgttggcaccatcggtcacgttgaccatggtaaaaccaccctgactgccgctttgactactattttagctaaaaaattcggcggcgctgcaaaagcttacgaccaaatcgacaacgcacccgaagaaaaagcacgcggtattaccattaacacctcgcacgtagaatacgaaaccgaaacccgccactacgcacacgtagactgtccgggtcacgccgactacgttaaaaacatgattaccggcgccgcacaaatggacggtgcaatcctggtatgttctgctgccgacggccctatgccgcaaacccgcgaacacatcctgctggcccgtcaagtaggcgtaccttacatcatcgtgttcatgaacaaatgcgacatggtcgacgatgccgagctgttggaactggttgaaatggaaatccgcgacctgctgtccagctacgacttccccggcgacgactgcccgatcgtacaaggttccgcactgaaagccttggaaggcgatgccgcttacgaagaaaaaatcttcgaactggctaccgcattggacagctacatcccgactcccgagcgtgccgtggacaaaccattcctgctgcctatcgaagacgtgttctccatttccggccgcggtaccgtagtcaccggccgtgtagagcgaggtatcatccacgttggtgacgagattgaaatcgtcggtctgaaagaaacccaaaaaaccacctgtaccggcgttgaaatgttccgcaaactgctggacgaaggtcaggcgggcgacaacgtaggcgtattgctgcgcggtaccaaacgtgaagacgtagaacgcggtcaggtattggccaaaccgggtactatcactcctcacaccaagttcaaagcagaagtgtacgtattgagcaaagaagagggcggccgccataccccgtttttcgccaactaccgtccccaattctacttccgtaccactgacgtaaccggcgcggttactttggaaaaaggtgtggaaatggtaatgccgggtgagaacgtaaccattactgtagaactgattgcgcctatcgctatggaagaaggtctgcgctttgcgattcgcgaaggcggccgtaccgtgggtgccggcgtggtttcttctgttatcgct

SEQ ID NO: 7966 - protein, 394 aa, Neisseria gonorrhoeae
MAKEKFERSKPHVNVGTIGHVDHGKTTLTAALTTILAKKFGGAAKAYDQIDNAPEEKARGITINTSHVEYETETRHYAHVDCPGHADYVKNMITGAAQMDGAILVCSAADGPMPQTREHILLARQVGVPYIIVFMNKCDMVDDAELLELVEMEIRDLLSSYDFPGDDCPIVQGSALKALEGDAAYEEKIFELATALDSYIPTPERAVDKPFLLPIEDVFSISGRGTVVTGRVERGIIHVGDEIEIVGLKETQKTTCTGVEMFRKLLDEGQAGDNVGVLLRGTKREDVERGQVLAKPGTITPHTKFKAEVYVLSKEEGGRHTPFFANYRPQFYFRTTDVTGAVTLEKGVEMVMPGENVTITVELIAPIAMEEGLRFAIREGGRTVGAGVVSSVIA

SEQ ID NO: 7967 - DNA, 141 bp, Neisseria gonorrhoeae
gtgtttgggtttcggatgtcgaaggaagggcttttttgcaaaggcctcaacccaacttacgcaaccataaaaactgaatgccaatctcttaaccatgctattcaaatttatttgaacgatttttttctaaccagccaacct

SEQ ID NO: 7968 - protein, 47 aa, Neisseria gonorrhoeae
VFGFRMSKEGLFCKGLNPTYATIKTECQSLNHAIQIYLNDFFLTSQP

SEQ ID NO: 7969 - DNA, 249 bp, Neisseria gonorrhoeae
atgtcgctttttattaccgacgagtgcatcaactgcgacgtatgcgaacccgaatgccccaatgatgccatttcccaaggcgaggaaatttacgaaatcaaccccaacctctgcacgcagtgcgtcggacactacgatgagccgcagtgccagcaggtttgcccggtggactgcatcctgattgacgaagaacatcccgaaacccatgacgagttgatggcgaaatacgaaaagattatccagtttaaa

SEQ ID NO: 7970 - protein, 83 aa, Neisseria gonorrhoeae
MSLFITDECINCDVCEPECPNDAISQGEEIYEINPNLCTQCVGHYDEPQCQQVCPVDCILIDEEHPETHDELMAKYEKIIQFK

SEQ ID NO: 7971 - DNA, 255 bp, Neisseria gonorrhoeae; identical to SEQ ID NO: 7039

SEQ ID NO: 7972 - protein, 85 aa, Neisseria gonorrhoeae; identical to SEQ ID NO: 7040

SEQ ID NO: 7973 - DNA, 99 bp, Neisseria gonorrhoeae
ttggggcgaaaacagctgaaaacctgtgtttgggtttcggatgtcgaaggaagggcttttttgcaaaggcctcaacccaacttacgcaaccataaaaac

SEQ ID NO: 7974 - protein, 33 aa, Neisseria gonorrhoeae
LGRKQLKTCVWVSDVEGRAFLQRPQPNLRNHKN

SEQ ID NO: 7975 - DNA, 135 bp, Neisseria gonorrhoeae
atggcatcattggggcattcgggttcgcatacgtcgcagttgatgcactcgtcggtaataaaaagcgacatttcttttccttttccactaaattatcaaaaccgggcgggcgcggattatagcacaaggtttttt

SEQ ID NO: 7976 - protein, 45 aa, Neisseria gonorrhoeae
MASLGHSGSHTSQLMHSSVIKSDISFPFPLNYQNRAGADYSTRFF

SEQ ID NO: 7977 - DNA, 447 bp, Neisseria gonorrhoeae
atgagcaccttcttccggcaaaccgcccaagccatgactgccaaacacatcggccgcttcccgctatcggagttggaccaggtgattgattggcagccgatcgaacaatacctgatccgacaaaaaacccgttacctccgagaccgccgcggccgtcccgcccatcccctgtcgtccatgttcaaagccgtcctgcccggacaatggcacagcctctccgatcccgaactcgaacacagcctcatcacccgcatcggtttcaacctgttttgccgttttgacggaccgggcatccccggttgcagcaccttatgccgctaccgtaaattccgctatgcgcgggcagcctatttcgggctgctcaaagtgggtgcgcaaagccacctgaaggcgatgtgtttgaacctgttgaaagccgccaacaggctaagtgcgcccgctgccgcc

SEQ ID NO: 7978 - protein, 149 aa, Neisseria gonorrhoeae
MSTFFRQTAQAMTAKHIGRFPLSELDQVIDWQPIEQYLIRQKTRYLRDRRGRPAHPLSSMFKAVLPGQWHSLSDPELEHSLITRIGFNLFCRFDGPGIPGCSTLCRYRKFRYARAAYFGLLKVGAQSHLKAMCLNLLKAANRLSAPAAA

SEQ ID NO: 7979 - DNA, 114 bp, Neisseria gonorrhoeae
ttgcccatcggcgtgggcaaaaccgaagacttgggcagcgacatcgcgctggtgtccgacaccgccgagctgacctacgcctacttgcaaaatgtgtgggaacagtcgggcaga

SEQ ID NO: 7980 - protein, 38 aa, Neisseria gonorrhoeae
LPIGVGKTEDLGSDIALVSDTAELTYAYLQNVWEQSGR

SEQ ID NO: 7981 - DNA, 102 bp, Neisseria gonorrhoeae
atgcgctttgataatcatttccgggttgtaaacattcgtttgcaaccgtccggttcaaaaaaaccttgtgctataatccgcgcccgcccggttttgataatt

SEQ ID NO: 7982 - protein, 34 aa, Neisseria gonorrhoeae
MRFDNHFRVVNIRLQPSGSKKPCAIIRARPVLII

SEQ ID NO: 7983 - DNA, 99 bp, Neisseria gonorrhoeae
ttgcccataccgtccgccatcgccgtttccgttcgggcaatggtcttcgcgcggcatttatgtagttgtatgggtagattgagtggttatttggcgata

SEQ ID NO: 7984 - protein, 33 aa, Neisseria gonorrhoeae
LPIPSAIAVSVRAMVFARHLCSCMGRLSGYLAI

SEQ ID NO: 7985 - DNA, 960 bp, Neisseria gonorrhoeae; identical to SEQ ID NO: 247

SEQ ID NO: 7986 - protein, 320 aa, Neisseria gonorrhoeae; identical to SEQ ID NO: 248

SEQ ID NO: 7987 - DNA, 555 bp, Neisseria gonorrhoeae
ttgggcatcggcatcgaccgcaagtttaacgagcagctcaaaggcgtgtcgcgcgacgattcgctcaaacgcatcctcgcgcacggcggcaaaaccgtcggcgaaaccgagttcgccgaactgacctgccgcaaaaacgacaactacttggagatgattcaggcagtcaaacccgaagacgtgtaccccggcattttgccgctgctggaagcattgagggcaaacggcaaaaaaatcgccctcgcgtccgccagtaaaaacggcccgttcttgctcgaacgcatggggctgacccacttcttcgacaccgtcgccgaccctgccgccgtcgcgcattccaaaccctcccccgacatcttccttgccgccgccgagggcgtgggtgcggacatacgccgctgccggcgtcgccgccatcaaagcctctggcgctttgcccatcggcgtgggcaaaaccgaagacttgggcagcgacatcgcgctggtgtccgacaccgccgagctgacctacgcctacttgcaaaatgtgtgggaacagtcgggcagataaaattc

SEQ ID NO: 7988 - protein, 185 aa, Neisseria gonorrhoeae
LGIGIDRKFNEQLKGVSRDDSLKRILAHGGKTVGETEFAELTCRKNDNYLEMIQAVKPEDVYPGILPLLEALRANGKKIALASASKNGPFLLERMGLTHFFDTVADPAAVAHSKPSPDIFLAAAEGVGADIRRCRRRRHQSLWRFAHRRGQNRRLGQRHRAGVRHRRADLRLLAKCVGTVGQIKF

SEQ ID NO: 7989 - DNA, 666 bp, Neisseria gonorrhoeae
atgggcaaagcgccagaggctttgatggcggcgacgccggcagcggcgtatgtccgcacccacgccctcggcggcggcaaggaagatgtcgggggagggtttggaatgcgcgacggcggcagggtcggcgacggtgtcgaagaagtgggtcagccccatgcgttcgagcaagaacgggccgtttttactggcggacgcgagggcgatttttttgccgtttgccctcaatgcttccagcagcggcaaaatgccggggtacacgtcttcgggtttgactgcctgaatcatctccaagtagttgtcgtttttgcggcaggtcagttcggcgaactcggtttcgccgacggttttgccgccgtgcgcgaggatgcgtttgagcgaatcgtcgcgcgacacgcctttgagctgctcgttaaacttgcggtcgatgccgatgcccaattcttcggcaagctttttccatgcgaggtagtggtattcggcggtatcggtaatcacgccgtcgagatcgaagagcactgcggtaaaagtcattttgcgccctccttatttttccaatgcaacggtgtggctgccgttgagcgtgatgtctttgccgtacacctgcaattcgagcggatcgcctttgagcagggtgaagacgacgttttttgccgacggcgactt

SEQ ID NO: 7990 - protein, 222 aa, Neisseria gonorrhoeae
MGKAPEALMAATPAAAYVRTHALGGGKEDVGGGFGMRDGGRVGDGVEEVGQPHAFEQERAVFTGGREGDFFAVCPQCFQQRQNAGVHVFGFDCLNHLQVVVVFAAGQFGELGFADGFAAVREDAFERIVARHAFELLVKLAVDADAQFFGKLFPCEVVVFGGIGNHAVEIEEHCGKSHFAPSLFFQCNGVAAVERDVFAVHLQFERIAFEQGEDDVFCRRRL

SEQ ID NO: 7991 - DNA, 495 bp, Neisseria gonorrhoeae
ttgagttttgcatccgccgacggactgcgcccaacccccgacagcgtgcgtgaaaagctgtttaactggctgggacaagatttgacgggaaaaacggttttggatctcttcggaggcagcggcgcactcggcatggaggcggcatcgcgtaatgcaaaacgggtcgtgattgcagacaacaaccgtcaaacggtgcaaacccttgagaaaaacagccgcgaactgggtttggggcaggtgcaaaccgtctgttcggacggcattgcctatttggcaaacctaaaagagaaattcgatgtcgtcttccttgatccgccgtttgcgtggcaaagttgggaaagtcttttcaatgtattgggcacacgcctgaatgacggcgcatatgtttatatcgaggcaggcaggcagccggacaaacctgattggctgacgggatatagggaggggaagtcggggcagggtacatttgaattaagggttttccaagtggctgaa

SEQ ID NO: 7992 - protein, 165 aa, Neisseria gonorrhoeae
LSFASADGLRPTPDSVREKLFNWLGQDLTGKTVLDLFGGSGALGMEAASRNAKRVVIADNNRQTVQTLEKNSRELGLGQVQTVCSDGIAYLANLKEKFDVVFLDPPFAWQSWESLFNVLGTRLNDGAYVYIEAGRQPDKPDWLTGYREGKSGQGTFELRVFQVAE

SEQ ID NO: 7993 - DNA, 888 bp, Neisseria gonorrhoeae
ttgggctacacccgcgaagccttggcgaaatacccgcgtccgggttcgaacgtgagcgccgccgagttggaaaaatgggcggacatcagcgcgaatatgtaccgtccgcatgacgaagaactcggcgtattcgtgcagcacgacggcttccttgacaaagacatccgccccgtatccgcgctttcgcccgacgatttgccgctcaaccagaaatggtcgtgggacaaaatcctgcgttcgcccttcatcaaacaggcggacgtattgcaaggcatctacttcttcggcgaccgtttcgacatggacgaaaaacgccgcaacttcgacttctacgaaccgatgaccgtgcatgaaagctcgttgtctccatgtatccactccatcctcgctgccgaactgggcaaagaagaaaaagccgtggaaatgtaccggcgcaccgcccgcctggacttggacgactacaacaacgacaccgaagacggcctgcatattacttctatgaccggctcgtggctcgccatcgtccaaggtttcgcccaaatgaaaacttggggcggcaaactcagcttcgcaccgttcctgccgagtgcgtggacaggctatgccttccacatcaactaccgcggccgtctgattaaagtcgccgtcggcaaaaaacgtcgtcttcaccctgctcaaaggcgatccgctcgaattgcaggtgtacggcaaagacatcacgctcaacggcagccacaccgttgcattggaaaaataaggagggcgcaaaatgacttttaccgcagtgctcttcgatctcgacggcgtgattaccgataccgccgaataccactacctcgcatggaaaaagcttgccgaagaattgggcatcggcatcgaccgcaagtt

SEQ ID NO: 7994 - protein, 296 aa, Neisseria gonorrhoeae
LGYTREALAKYPRPGSNVSAAELEKWADISANMYRPHDEELGVFVQHDGFLDKDIRPVSALSPDDLPLNQKWSWDKILRSPFIKQADVLQGIYFFGDRFDMDEKRRNFDFYEPMTVHESSLSPCIHSILAAELGKEEKAVEMYRRTARLDLDDYNNDTEDGLHITSMTGSWLAIVQGFAQMKTWGGKLSFAPFLPSAWTGYAFHINYRGRLIKVAVGKKRRLHPAQRRSARIAGVRQRHHAQRQPHRCIGKIRRAQNDFYRSALRSRRRDYRYRRIPLPRMEKACRRIGHRHRPQV

SEQ ID NO: 7995 - DNA, 1065 bp, Neisseria gonorrhoeae
ttgagcagggtgaagacgacgttttttgccgacggcgactttaatcagacggccgcggtagttgatgtggaaggcatagcctgtccacgcactcggcaggaacggtgcgaagctgagtttgccgccccaagttttcatttgggcgaaaccttggacgatggcgagccacgagccggtcatagaagtaatatgcaggccgtcttcggtgtcgttgttgtagtcgtccaagtccaggcgggcggtgcgccggtacatttccacggctttttcttctttgcccagttcggcagcgaggatggagtggatacatggagacaacgagctttcatgcacggtcatcggttcgtagaagtcgaagttgcggcgtttttcgtccatgtcgaaacggtcgccgaagaagtagatgccttgcaatacgtccgcctgtttgatgaagggcgaacgcaggattttgtcccacgaccatttctggttgagcggcaaatcgtcgggcgaaagcgcggatacggggcggatgtctttgtcaaggaagccgtcgtgctgcacgaatacgccgagttcttcgtcatgcggacggtacatattcgcgctgatgtccgcccatttttccaactcggcggcgctcacgttcgaacccggacgcgggtatttcgccaaggcttcgcgggtgtagcccaatacccatgcggcgagggtgttggtttaccagttgttgttgatgttgttttcgtattcgttcggaccggttacgccttgaatcatgtatttgccgttgcgtttggagaagtggacgcggtccgcccggaagcgggacacttcgaccaagacttccaagccttctttggcaagatagcactcgtcaccggtgtagttggtgtagttgtagatggcgtaaggaatcgcgccgttacggtggatttcctcgaaggtgatttcccattcgttgtggcactcgatgcccgtaaacgttaccatcggatagagtgcgcccgccaagccctgttcgcgtgcgttatgctgcgcctgcggcaatttggttgcggcggtattgcagcaggttgcggg

SEQ ID NO: 7996 - protein, 355 aa, Neisseria gonorrhoeae
LSRVKTTFFADGDFNQTAAVVDVEGIACPRTRQERCEAEFAAPSFHLGETLDDGEPRAGHRSNMQAVFGVVVVVVQVQAGGAPVHFHGFFFFAQFGSEDGVDTWRQRAFMHGHRFVEVEVAAFFVHVETVAEEVDALQYVRLFDEGRTQDFVPRPFLVERQIVGRKRGYGADVFVKEAVVLHEYAEFFVMRTVHIRADVRPFFQLGGAHVRTRTRVFRQGFAGVAQYPCGEGVGLPVVVDVVFVFVRTGYALNHVFAVAFGEVDAVRPEAGHFDQDFQAFFGKIALVTGVVGVVVDGVRNRAVTVDFLEGDFPFVVALDARKRYHRIECARQALFACVMLRLRQFGCGGIAAGCG

SEQ ID NO: 7997 - DNA, 234 bp, Neisseria gonorrhoeae
ttgctgtgtttggtatgtttgcctgccgccataatcaaaagcctgaaagttcaaacggtattatacaagacctgtcgaagaatatgccgcctgaaaacttttttcagacggcatatctgtttaaacggtttcggtcagcttgcggagcaactcgatttctttgtcttttgttccaacatttctttgcagtgtttcaattccatttttaacaaatccagctttaccgatgcatcc

SEQ ID NO: 7998 - protein, 78 aa, Neisseria gonorrhoeae
LLCLVCLPAAIIKSLKVQTVLYKTCRRICRLKTFFRRHICLNGFGQLAEQLDFFVFCSNISLQCFNSIFNKSSFTDAS

SEQ ID NO: 7999 - DNA, 327 bp, Neisseria gonorrhoeae
ttgccgcaggcgcagcataacgcacgcgaacagggcttggcgggcgcactctatccgatggtaacgtttacgggcatcgagtgccacaacgaatgggaaatcaccttcgaggaaatccaccgtaacggcgcgattccttacgccatctacaactacaccaactacaccggtgacgagtgctatcttgccaaagaaggcttggaagtcttggtcgaagtgtcccgcttccgggcggaccgcgtccacttctccaaacgcaacggcaaatacatgattcaaggcgtaaccggtccgaacgaatacgaaaacaacatcaacaacaactgg

SEQ ID NO: 8000 - protein, 109 aa, Neisseria gonorrhoeae
LPQAQHNAREQGLAGALYPMVTFTGIECHNEWEITFEEIHRNGAIPYAIYNYTNYTGDECYLAKEGLEVLVEVSRFRADRVHFSKRNGKYMIQGVTGPNEYENNINNNW

SEQ ID NO: 8001 - DNA, 336 bp, Neisseria gonorrhoeae
atgccgtctgaaccttcagacggcatttttgacgcgctcgccgtttacgggcgcggggcaggtgcggggaaatacccgtaccgccattgccgatacaccgtaaccctaaaacccgccattcccgcgcaggcgggaatccggatttgtcgggattcgctcaaatcgggtggcggagggatggtgttgcagattaacgatgtggataccaacagcggggaatttgcaatctataccgctcaggatgcatcggtaaagctggatttgttaaaaatggaattgaaacactgcaaagaaatgttggaacaaaagacaaagaaatcgagttgctccgcaagc

SEQ ID NO: 8002 - protein, 112 aa, Neisseria gonorrhoeae
MPSEPSDGIFDALAVYGRGAGAGKYPYRHCRYTVTLKPAIPAQAGIRICRDSLKSGGGGMVLQINDVDTNSGEFAIYTAQDASVKLDLLKMELKHCKEMLEQKTKKSSCSAS

SEQ ID NO: 8003 - DNA, 1224 bp, Neisseria gonorrhoeae
ttgttaatccactataagatttcaccattccctcaaatcaatccaaacaggagctttacgatgtacacaagaattatggaaatcagcccttggacgctgcgttcggcaaaactggaaaaagaacacaaacggctgcaagagagcctgaccagcttgggcaacggctatatgggtatgcgcggcagctttgaggaaacctactccgccgacagccacttgggcacctacatcgccggcgtgtggtttcccgacaaaacccgcgtcggctggtggaaaaacggctatcccaaatatttcggcaaagccatcaacgcgctcaatttcagcaaagtcaaaatctttgtcgacgggcaagaggtggacttggcgaaaaacgacgttgccggcttctccgtcgaactggatatgcaacacggcgtgttgcgccgctcgttcaccgtattcggtgtgcgtttcgatgtgtgcaaattcctgtcggtcgcgcaaaaagagctggctctcacccgctgggaagccgtgtccgttgacggcaaaacccaccaagtccgcatcgattccatcatcgatgccgacgtgaaaaacgaagactccaactacgaagaaaaattctggcaggtattggacaaaggcgtttcagacgaccgctcctacattgccgcccaaaccgtcgccaaccctttcggtgtggaacaatttatcgtcaacgccgggcaaaccttcgccggcagcttcaaagccttcggcggcagccaaaccgattggcaggtctctaattcttttgaagccgaagtcggcggcacgcccgaaacctttgaaaaacgcgtgattgttaccaccagccgcgattatcagggcttggaagcagtgaaagccgccggccgcgccttatctgaaaaaatcgcaggtgttgcgtttgaaaccttgctggatgcgcacaaagcaggctggcagcatcgttgggaaatcgccgacgtggtcatcgaaggcagcgacgaagcacagcagggcatccgcttcaacctgttccaactgttctccacctactacggcgaagacgcgcgtctgaacatcggccccaaaggctttaccggcgaaaaatacggcggcgcgacctattgggacaccgaagcctacgccgtgccgctctaccttgcactggcggaacccgaagttacccgcaacctgctgcaataccgccgcaaccaaattgccgcaggcgcagca

SEQ ID NO: 8004 - protein, 408 aa, Neisseria gonorrhoeae
LLIHYKISPFPQINPNRSFTMYTRIMEISPWTLRSAKLEKEHKRLQESLTSLGNGYMGMRGSFEETYSADSHLGTYIAGVWFPDKTRVGWWKNGYPKYFGKAINALNFSKVKIFVDGQEVDLAKNDVAGFSVELDMQHGVLRRSFTVFGVRFDVCKFLSVAQKELALTRWEAVSVDGKTHQVRIDSIIDADVKNEDSNYEEKFWQVLDKGVSDDRSYIAAQTVANPFGVEQFIVNAGQTFAGSFKAFGGSQTDWQVSNSFEAEVGGTPETFEKRVIVTTSRDYQGLEAVKAAGRALSEKIAGVAFETLLDAHKAGWQHRWEIADVVIEGSDEAQQGIRFNLFQLFSTYYGEDARLNIGPKGFTGEKYGGATYWDTEAYAVPLYLALAEPEVTRNLLQYRRNQIAAGAA

SEQ ID NO: 8005 - DNA, 843 bp, Neisseria gonorrhoeae
ttgatatgcatacggccgacaaaaaacttctcttctcttctcttctcttctcttctcttctcttctcttctcttctcttctcttctcttctcttccgcagcgcgggcggcgggtgaagaccatgggcgcggcccgtatgtgcaggcggatctggcttacgcctacgagcacatcacccgcgattatcccgatgcagccggtgcaaaccaaggcaaaaaaataagcacggtaagcgattatttcaaaaacatccgcacccgctccgtccacccccggcttgccttcggctacgatttcggcggctggcgcatcgccgcggattatgcccgttacaggaaatggcacaacaataaatattccgtgaacataaaagagttgggaagaaacgataatagcgcttctgacagcaagcatcttaacataaaaacccaaaagacggaacatcaagaaaacggcacattccacgccgtttcttctctcggcttgtcaaccgtttacgatttcagagccaacgataaattcaaaccctatatcggcgtgcgcgtcgcctacggacacgtcagacatcaggttcattcaatggaaaaagaaaccacgactgttaccacttacccaagcgacggtagtgcgaaaacttctgttccatcagaaatgccccccaaacctgcctatcacgaaaaccgcagcagccgccgcttgggcttcggcgcgatggcgggcgtgggcatagacgtcgcgcccggcctgaccttggacgccggctaccgctaccactattggggacgcctggaaaacacccgcttcaaaacccacgaagcctcattgggcgtgcgctaccgcttc

SEQ ID NO: 8006 - protein, 281 aa, Neisseria gonorrhoeae
LICIRPTKNFSSLLFSSLLFSSLLFSSLLFSSAARAAGEDHGRGPYVQADLAYAYEHITRDYPDAAGANQGKKISTVSDYFKNIRTRSVHPRLAFGYDFGGWRIAADYARYRKWHNNKYSVNIKELGRNDNSASDSKHLNIKTQKTEHQENGTFHAVSSLGLSTVYDFRANDKFKPYIGVRVAYGHVRHQVHSMEKETTTVTTYPSDGSAKTSVPSEMPPKPAYHENRSSRRLGFGAMAGVGIDVAPGLTLDAGYRYHYWGRLENTRFKTHEASLGVRYRF

SEQ ID NO: 8007 - DNA, 267 bp, Neisseria gonorrhoeae
gtgccgtccgatataggccgtcccgccgccgtgttgcaagccggacgccgccgtcgtatcagcatatacagcgaccgcaacggcttggtcatctttaccgccgccccgcaggatttcgcgcggcacgatgcgggcgtttacgacgcgctggcgaccgaggcgcagacgctgcccgacagcctgcattggcccgaattcggcaatatccgtctgaacaagggtgatactagggaggcgacgattgcttacggcatcgaatccctttct

SEQ ID NO: 8008 - protein, 89 aa, Neisseria gonorrhoeae
VPSDIGRPAAVLQAGRRRRISIYSDRNGLVIFTAAPQDFARHDAGVYDALATEAQTLPDSLHWPEFGNIRLNKGDTREATIAYGIESLS

SEQ ID NO: 8009 - DNA, 426 bp, Neisseria gonorrhoeae
gtgcggcgttcgacatcaacggtaggacttaccgcgtggaggccaacgaaggcaggaacgcgctgcacggcggttcgcacgggctggccgttacccgtttcaacgcggtggcggcagacggccgacggttatcccaacgatttggatatttcctaccgcttggacgaggacggccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtcttaacggtttcagacggcctcgaagtatttgatttcagccggcccaagccgccggatgccgccgttgccgccctgcgccgcgaaacgggccggttt

SEQ ID NO: 8010 - protein, 142 aa, Neisseria gonorrhoeae
VRRSTSTVGLTAWRPTKAGTRCTAVRTGWPLPVSTRWRQTADGYPNDLDISYRLDEDGRLTVTYRATALGDTVFDPTLHIYWRLDAGLHDAVLHIPQGGHIPADAEKLPVLTVSDGLEVFDFSRPKPPDAAVAALRRETGRF

SEQ ID NO: 8011 - DNA, 609 bp, Neisseria gonorrhoeae
atgagcgatacccccgctacccgcgatttcggcctgatcgacgggcgggccgtaaccggctatgtgctgtccaaccggcgtggtacgtgcgtcttcgtgctggacttgggcgggattgtgcaggaattttccgttttggcagacggcgtgcgcgaaaaccccgtggtgtcgttcgacgatgcggcttcctatgcggacaatccgtttcagattaacaagcagatagggcgcgtggccggacgcatccgcggtgcggcgttcgacatcaacggtaggacttaccgcgtggaggccaacgaaggcaggaacgcgctgcacggcggttcgcacgggctggccgttacccgtttcaacgcggtggcggcagacggccgacggttatcccaacgatttggatatttcctaccgcttggacgaggacggccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtcttaacggtttcagacggcctcgaagtatt

SEQ ID NO: 8012 - protein, 203 aa, Neisseria gonorrhoeae
MSDTPATRDFGLIDGRAVTGYVLSNRRGTCVFVLDLGGIVQEFSVLADGVRENPVVSFDDAASYADNPFQINKQIGRVAGRIRGAAFDINGRTYRVEANEGRNALHGGSHGLAVTRFNAVAADGRRLSQRFGYFLPLGRGRPAYRYLSRHRARRHGVRPDAAHLLAAGRGPARCGSAYSAGRTYSGRCRKTARLNGFRRPRSI

SEQ ID NO: 8013 - DNA, 312 bp, Neisseria gonorrhoeae
ttgtttatacggattgttcgtagttacgatgtatcagattgtaagcggatttggccgtttccgtatcaatcgcggcacacattttgccgaacggcaaaaccatatcaacgcaattgggaacttttggaatcgggcaaacgtcatttgcgcaagtttgacggcattcccaaagagcatttcgggctgtatttgaaggagtgcggacggcgttttgacaacagtggggtaaaagttcgaatttccattttaaaacaattggtaaagcaggatttatcccggctggccgggattttaaaaaataaatacattctt

SEQ ID NO: 8014 - protein, 104 aa, Neisseria gonorrhoeae
LFIRIVRSYDVSDCKRIWPFPYQSRHTFCRTAKPYQRNWELLESGKRHLRKFDGIPKEHFGLYLKECGRRFDNSGVKVRISILKQLVKQDLSRLAGILKNKYIL

SEQ ID NO: 8015 - DNA, 246 bp, Neisseria gonorrhoeae
gtgaaacacgctgcgtcaaaatcgaacagcatcgaactttcccttatggtcgcgcttgataaagttttgatgaatgcaaaatatgaaggaagttttcctaacaaattagggagggatcatattattgcggtacacaaatactcaaccggtgtcagatttggcaataaagtcttaaaaatcaggataatagcccgtgagaaatttgatgggataaaacattacgatcattttattttgaaagacaaa

SEQ ID NO: 8016 - protein, 82 aa, Neisseria gonorrhoeae
VKHAASKSNSIELSLMVALDKVLMNAKYEGSFPNKLGRDHIIAVHKYSTGVRFGNKVLKIRIIAREKFDGIKHYDHFILKDK

SEQ ID NO: 8017 - DNA, 240 bp, Neisseria gonorrhoeae
atgccctttcttagggacgcaatatataaggtttataccgtcgttgtccctaatgcgcaatcagcgacattgttgccaattatccgaaagaaagttaagcctgatggcattgtatacacggatacctttcgtagttatgatgtgcttgatgttagtgaatttagccatttacgtaagtttaacggcattcccaaagagcatttggggctatatttaaagaaatgccaatggcatttgaaa

SEQ ID NO: 8018 - protein, 80 aa, Neisseria gonorrhoeae
MPFLRDAIYKVYTVVVPNAQSATLLPIIRKKVKPDGIVYTDTFRSYDVLDVSEFSHLRKFNGIPKEHLGLYLKKCQWHLK

SEQ ID NO: 8019 - DNA, 1674 bp, Neisseria gonorrhoeae
atcgttggtatttgccgttacctcttccaatgaagtaatgccctgcataattttcaaaataccggcccggcgcaaatccaccataccctccttataggcaacgtccaaaatacccacttccgtaccgttgttcataatcacacgctgcatttcttcgctgatgggcataacctcatacacgcccgcacgccccttataaccctgcccccggcaacggtcgcaaccgacggcgcggtaaagtttccaatcttttgcaagatcctcatcggtgaaaccgacttccttcaaagcagaggcagacgggcgttccacttcctgtttgcagctcgaacacagcctgcgtaaaagacgctgcgccataatcaggctgaccgaactggcaatattaaacggcgcgacacccatattcagcatacgcgacaacgtcgccggcgcattattcgtgtgcagtgtggaaaacaccatatgccctgtttgtgccgccttaatcgcaatatcggcagtttccaaatcacgaatctcaccgaccataatgatgtccgggtcctgacgcaggaaagacttcaaagcagcggcaaaagtcagaccctgcttatcattgacgttaacctgattgatgcccggcaggttaatctcggcagggtcttccgccgttgcaatatttaccgactccgtattcaaaatattcaaacaggtatagagcgacaccgtcttacccgaacccgtcggaccggttaccagcaccatcccgtaaggacggtgaatcgcttccaacaacaattttttctggaacggctcaaaaccgagctggtcgatgttcaaagacgcggcatcggaattcaaaatccgcatcacgaccttttcgccaaacagcgtcggcaatgtgctgacacggaaatcgacaggcttgccgcccttttgaaaggtcagctgcatcctaccgtcctgcggtatccgtttttcggaaatgtccaaacgcgacattaccttaatccgggaagcaagctgcccccttaccgcaatgggcggctgaaccacctcgcggagctgcccgtccacacggaaacggatacgcgcattgtgttcgtaaaactcgaaatggatgtcggatgccccgctacgcaaggcatccgacaaagttttatggataaacctcggaacagggccgtcttctgcctcctcgttgtcgatatacagggtgtggctttcctcttcctcttgcccctccccaagctcctgaagcagcgatgtcgaacgcgaacccacccaatcgagcaaacccgccaactggtcatcctcgacaatgaccaactcaaccgcaatccctgcggcagaaacggttttctgaatttgcggcatctgggtcggatcggaaaccgcaaaaaatactttgtcgccccgacggaaaaccggcacacagtggaactccaccatctgctcctccgtcaacacccccatcagcaccctgtggcgcggataatgacgcaaatcaagaatcgaataactgaacaccctcgcaatcaatgccgcaagcgacttgggcgaaatgacaccgtctgaaaacagcatcggcaacacttccttacccgcctgcgactcattgtagtaatgctcggcccgctcaacagtaaccacctggttttgaaccagaatcctcagcaaacctacgctcat

SEQ ID NO: 8020 - protein, 10 aa, Neisseria gonorrhoeae
IVGICRYLFQ

SEQ ID NO: 8021 - DNA, 123 bp, Neisseria gonorrhoeae
ttggcacatcatcgggaaaacttcctttacacgcatttggacgaaatctgcgaaattatggaggcatacgacatatcgtttacgattacttatccgtcaaaacagtccgcatttggaaatgta

SEQ ID NO: 8022 - protein, 41 aa, Neisseria gonorrhoeae
LAHHRENFLYTHLDEICEIMEAYDISFTITYPSKQSAFGNV

SEQ ID NO: 8023 - DNA, 402 bp, Neisseria gonorrhoeae
gtgatttgttcgtttattctggcaaaagtaccgaataaataccataaggcgggttatttcggctgtttggctttgggcgcgctcggtttcttctctatcttcttcatctacaatcaatacgcactcatcctgtcttatatcttaatcggcatcgcttgggcgggcattatcacttatccgctgacgattgtggccaacgctttgtcgggcaaacacatggatacttatttgggcctgtttaacggctctgtctgtatgccgcaaatcgtcgcttcgctgttgagtttcgtgcttttcccgatgctgggcggccatcaggcaaccatgttcttggttgcaggcgcagtcttgctgctgggagccttctcagtctgtctgattaaagagatccacggcggggtt

SEQ ID NO: 8024 - protein, 134 aa, Neisseria gonorrhoeae
VICSFILAKVPNKYHKAGYFGCLALGALGFFSIFFIYNQYALILSYILIGIAWAGIITYPLTIVANALSGKHMDTYLGLFNGSVCMPQIVASLLSFVLFPMLGGHQATMFLVAGAVLLLGAFSVCLIKEIHGGV

SEQ ID NO: 8025 - DNA, 552 bp, Neisseria gonorrhoeae
ttggcagcagttaatcaaaacacggcagcctgttattttctatggcgaaatagtgtttggcacatcatcgggaaaacttcctttacacgcatttggacgaaatctgcgaaattatggaggcatacgacatatcgtttacgattacttatccgtcaaaacagtccgcatttggaaatgtatgacggcgaagcaggggcgggtgaaagttatttccgtaaaggcagacgcggccgcagtgccgccggcaaagccgccgtattcgggcttttgaagcgcaacggcaaggtttgtacggttactgtcggacactcgaaccgctattttattgcctattatccgcggacgggtgaaacccggcagcattgtttatacggattgttcgtagttacgatgtatcagattgtaagcggatttggccgtttccgtatcaatcgcggcacacattttgccgaacggcaaaaccatatcaacgcaattgggaacttttggaatcgggcaaacgtcatttgcgcaagtttgacggcattcccaaagagcatttcgggctgtatt

SEQ ID NO: 8026 - protein, 184 aa, Neisseria gonorrhoeae
LAAVNQNTAACYFLWRNSVWHIIGKTSFTRIWTKSAKLWRHTTYRLRLLIRQNSPHLEMYDGEAGAGESYFRKGRRGRSAAGKAAVFGLLKRNGKVCTVTVGHSNRYFIAYYPRTGETRQHCLYGLFVVTMYQIVSGFGRFRINRGTHFAERQNHINAIGNFWNRANVICASLTAFPKSISGCI

SEQ ID NO: 8027 - DNA, 1350 bp, Neisseria gonorrhoeae; identical to SEQ ID NO: 7093

SEQ ID NO: 8028 - protein, 450 aa, Neisseria gonorrhoeae; identical to SEQ ID NO: 7094

SEQ ID NO: 8029 - DNA, 105 bp, Neisseria gonorrhoeae; identical to SEQ ID NO: 7097

SEQ ID NO: 8030 - protein, 35 aa, Neisseria gonorrhoeae; identical to SEQ ID NO: 7098

SEQ ID NO: 8031 - DNA, 294 bp, Neisseria gonorrhoeae
atgtcggaatatacgcctcaaacagcaaaacaaggtttgcccgcgccggcaaaaagcacgatttggatgttgagcttcggctatctcggcgttcagacggcctttaccctgcaaagctcgcagatgagccgcatttttcaaacgctaggcgcagacccgcacaatttgggctggtttttcatcctgccgccgctggcggggatgctggttcagccgatagtggctactactcagaccgcacttggaagccgcgcttgggcggccgccgcctgccgtatctgctttacggcacgc

SEQ ID NO: 8032 - protein, 98 aa, Neisseria gonorrhoeae
MSEYTPQTAKQGLPAPAKSTIWMLSFGYLGVQTAFTLQSSQMSRIFQTLGADPHNLGWFFILPPLAGMLVQPIVATTQTALGSRAWAAAACRICFTAR

SEQ ID NO: 8033 - DNA, 1017 bp, Neisseria gonorrhoeae
atgataggggatcgccgcgccggcaaccatttcggattttccaaagcaaatacttttcaaatcaaaaaaaaggatttactttatgtcggaatatacgcctcaaacagcaaaacaaggtttgcccgcgccggcaaaaagcacgatttggatgttgagcttcggctatctcggcgttcagacggcctttaccctgcaaagctcgcagatgagccgcatttttcaaacgctaggcgcagacccgcacaatttgggctggtttttcatcctgccgccgctggcggggatgctggttcagccgatagtggctactactcagaccgcacttggaagccgcgcttgggcggccgccgcctgccgtatctgctttacggcacgctgattgcggtcatcgtgatgattttgatgccgaactcgggcagcttcggtttcggctatgcgtcgctggcggccttgtcgttcggcgcgctgatgattgcgctgttggacgtgtcgtcgaatatggcgatgcagccgtttaagatgatggtcggcgatatggtcaacgaggagcagaaaagctacgcctacgggattcaaagtttcttagcgaatacggacgcggttgtggcagcgattctgccgtttgtgttcgcgtatatcggtttggcgaacactgccgagaaaggcgttgtgccacaaaccgtggtcgtagcattctatgtgggtgcggcgttactgattattaccagtgcgttcacaatctccaaagtcaaagaatacgacccggaaacctacgcccgttaccacggcatcgatgtcgccgcgaatcaggaaaaagccaactggttcgaactcttaaaaaccgcgcctaaagtgttttggacggttactccggtacagtttttctgctggttcgccttccggtatatgtggacttactcggcaggcgcgattgcagaaaacgtctggcacactaccgatgcgtcttccgtaggccatcaggaggcgggcaaccggtacggcgttttggcggcggtg

SEQ ID NO: 8034 - protein, 339 aa, Neisseria gonorrhoeae
MIGDRRAGNHFGFSKANTFQIKKKDLLYVGIYASNSKTRFARAGKKHDLDVELRLSRRSDGLYPAKLADEPHFSNARRRPAQFGLVFHPAAAGGDAGSADSGYYSDRTWKPRLGGRRLPYLLYGTLIAVIVMILMPNSGSFGFGYASLAALSFGALMIALLDVSSNMAMQPFKMMVGDMVNEEQKSYAYGIQSFLANTDAVVAAILPFVFAYIGLANTAEKGVVPQTVVVAFYVGAALLIITSAFTISKVKEYDPETYARYHGIDVAANQEKANWFELLKTAPKVFWTVTPVQFFCWFAFRYMWTYSAGAIAENVWHTTDASSVGHQEAGNRYGVLAAV

SEQ ID NO: 8035 - DNA, 2244 bp, Neisseria gonorrhoeae
ttgggcggcgattttgaaatcctcgcgtcctacggacacgtccgcgacctcgtccccaaaagcggcgcggtcgatcccgacaacggctttgcgatgaaataccaactcatcagccgcaacggcaaacatgtcgatgcgattgttgccgctgccaaagaagccgaaaacatctacctcgcaaccgacccggacagggaaggcgaagcgatttcttggcatcttttggaaatcctcaaatccaaacgcggtctgaaaaacatcaagccgcagcgcgtcgtgttccacgagattaccaaaaacgccgtgctcgatgccgtcgcccatcctcgcgaaatcgaaatggatttggtcgatgcgcaacaagcccgccgcgctttggactatctggtcggtttcaacctctcgccgttgctgtggaaaaaaatccgacgcggtttgagcgcgggccgtgtgcaaagtcccgccctgcggctgatttgcgagcgcgaaaacgaaatccgcgcgtttgaagcgcaggaatattggacggtgcatctcgacagccataaaggccgcagcaagttcaccgccaaactcgcccaatacaacggcgcgaaactcgaacaattcgacctgccgaacgaagccgctcaagccgatgtgttgaaagaactcgaaggcaaagaggccgtcgttaccgccatcgaaaagaaaaagcgcagccgcaaccccgccgcgccgtttaccacatccaccatgcagcaggatgccgtgcgtaaactgggcttcaccaccgaccgcaccatgcgtaccgcccagcagctttacgaaggtatagacgtagggcagggtgccatcggtctgattacctatatgcgtaccgacagcgtgaatttggctgacgaagcgttaaccgaaatccgccattacattgaaaacaaaatcggcaaagaatatctgccgagtgccgccaaacaatacaaaaccaaatccaaaaacgcccaagaagcccatgaagcgatccgcccgacttccgtgtaccgcacgcccgaaagcgtcaaacccttcctgagtgcagaccagttcaaactctatcaaatgatttggcagcgtaccgttgcctgtcagatgacgcccgccaaattcgaccaaaccaccgtcgatattaccgtcggcaaaggcgtgttccgagtaaccggacaagtgcaaaccttcgcaggcttcctcagcgtttacgaagaaagcagcgacgatgaagagagcgaagacagcaaaaaactgcccgaaatgagcgaaggcgacaaattgccggtcgacaaactctacggcgaacaacacttcaccaccccgccgccgcgctacaacgaagccacactggttaaagccctcgaagaatacggcatcggccgcccctcgacctacgccagcattatttctacgctcaaagaccgcgaatacgttacccttgagcaaaaacgcttcatgcccaccgacacaggcgacatcgtcaataaattcctgaccgaacacttcgcccaatacgtcgattaccacttcaccgccaaactcgaagaccagcttgacgaaatcgccgacggcaaacgccgctggattcccgtgatggacaaattctggaaaccgttcatcaaacaagtggaagaaaaagagggcatcgaacgcgccaaattcactacgcaggaacttgacgaaacctgcccgaaatgcggcgaacacaaactgcaaatcaagttcggcaaaatgggccgtttcgttgcgtgtgccggttatcccgagtgcagttacacccgcaacgtcaacgaaaccgccgaagaagctgccgaacgcatcgccaaagcggaagccgaacaggtcgaactcgacggtcgcgaatgccccaaatgcggcggacggctggtgtacaaatacagccgcaccggcagtaaattcatcggttgcgccaactaccccaaatgcaaacacgtcgagccgttggaaaaacccaaagataccggcgtccaatgcccgcaatgcaaaaaaggcaacctcgtcgagcgcaaatcccgctacggcaaactgttttacagttgcagcacctatcccgactgcaactacgccacttggaacccgcccgttgccgaagaatgcccgaactgccattggccggtactggccatcaaaactaccaaacgccggggcgtggaaaaagtctgcccgcaaaaagaatgcggctggaaagaacaaatcgaaccgcctgcaccgcaagag

SEQ ID NO: 8036 - protein, 748 aa, Neisseria gonorrhoeae
LGGDFEILASYGHVRDLVPKSGAVDPDNGFAMKYQLISRNGKHVDAIVAAAKEAENIYLATDPDREGEAISWHLLEILKSKRGLKNIKPQRVVFHEITKNAVLDAVAHPREIEMDLVDAQQARRALDYLVGFNLSPLLWKKIRRGLSAGRVQSPALRLICERENEIRAFEAQEYWTVHLDSHKGRSKFTAKLAQYNGAKLEQFDLPNEAAQADVLKELEGKEAVVTAIEKKKRSRNPAAPFTTSTMQQDAVRKLGFTTDRTMRTAQQLYEGIDVGQGAIGLITYMRTDSVNLADEALTEIRHYIENKIGKEYLPSAAKQYKTKSKNAQEAHEAIRPTSVYRTPESVKPFLSADQFKLYQMIWQRTVACQMTPAKFDQTTVDITVGKGVFRVTGQVQTFAGFLSVYEESSDDEESEDSKKLPEMSEGDKLPVDKLYGEQHFTTPPPRYNEATLVKALEEYGIGRPSTYASIISTLKDREYVTLEQKRFMPTDTGDIVNKFLTEHFAQYVDYHFTAKLEDQLDEIADGKRRWIPVMDKFWKPFIKQVEEKEGIERAKFTTQELDETCPKCGEHKLQIKFGKMGRFVACAGYPECSYTRNVNETAEEAAERIAKAEAEQVELDGRECPKCGGRLVYKYSRTGSKFIGCANYPKCKHVEPLEKPKDTGVQCPQCKKGNLVERKSRYGKLFYSCSTYPDCNYATWNPPVAEECPNCHWPVLAIKTTKRRGVEKVCPQKECGWKEQIEPPAPQE

SEQ ID NO: 8037 - DNA, 459 bp, Neisseria gonorrhoeae
atgaccgaagtcatcgcctacctcatcgaacatttccaagatttcgatacctgcccgccgcccgaagacttgggtatgctgcttgaagaagcgggtttcgatacgatggaaatcggcaacaccctgatgatgatggaagtattgctcaacagctccgaattttccgccgaacccgccggcagcggcgcattgcgcgtgtacagcaaagaagaaaccgacaacctgccgcaggaagtgatggggctgatgcagtatctgattgaagaaaaagccgtcagctgcgaacagcgggaaatcatcatccacgcgctcatgcacatccccggcgacgaaattaccgtagataccgccaaagtgctgaccctgctgcttttatgggcaaacaagagcgagctgcccgtattggtcggcgacgagctgatgagcgcgcttttactcgacaacaaacccacgatgaac

SEQ ID NO: 8038 - protein, 153 aa, Neisseria gonorrhoeae
MTEVIAYLIEHFQDFDTCPPPEDLGMLLEEAGFDTMEIGNTLMMMEVLLNSSEFSAEPAGSGALRVYSKEETDNLPQEVMGLMQYLIEEKAVSCEQREIIIHALMHIPGDEITVDTAKVLTLLLLWANKSELPVLVGDELMSALLLDNKPTMN

SEQ ID NO: 8039 - DNA, 153 bp, Neisseria gonorrhoeae; identical to SEQ ID NO: 7125

SEQ ID NO: 8040 - protein, 51 aa, Neisseria gonorrhoeae; identical to SEQ ID NO: 7126

SEQ ID NO: 8041 - DNA, 93 bp, Neisseria gonorrhoeae; identical to SEQ ID NO: 4275

SEQ ID NO: 8042 - protein, 31 aa, Neisseria gonorrhoeae; identical to SEQ ID NO: 4276

SEQ ID NO: 8043 - DNA, 651 bp, Neisseria gonorrhoeae
atgaagataacacactgcaaattaaagaaagaagtacagaaagaaccgctccgttcttttgtaccggaagttaccgcccgttctgccgccgatattttgggtatccatcccgattcggcggcactgttttaccgtaaaatccgcacggttaccaaccatcgtttggccttggctgccgatgaggttttcgagggccccgccgggccgggcgcaagctgtttcggcggacggcgtaaaggcagacgcggtcgcggcgcggcaggaaaagcggttgtcttcggcattccgaaacgcaacgggcgggcctataccgttgccgcggacgatgccgagcctgaaacgttgctccctgccgtcaaaaagaaaatcatgccggacggtattgtttatgccgatagcccgggcagccgcggcaagtcggacgcgggcggttttacccgttgccgcatcaaccgttccaaggaatttgcagaccgtcggaaccacattaacggcattgggaacttttggaatcaggcaaaacgcgccttgcgaaaatacaacggaatcgaccgcaaacctttcccgccgttcttgaaggaatgcgaatttcgacttaacttcggcacaccgtcccggcagctaaaaatcctgcgggattggtgtggaatt

SEQ ID NO: 8044 - protein, 217 aa, Neisseria gonorrhoeae
MKITHCKLKKEVQKEPLRSFVPEVTARSAADILGIHPDSAALFYRKIRTVTNHRLALAADEVFEGPAGPGASCFGGRRKGRRGRGAAGKAVVFGIPKRNGRAYTVAADDAEPETLLPAVKKKIMPDGIVYADSPGSRGKSDAGGFTRCRINRSKEFADRRNHINGIGNFWNQAKRALRKYNGIDRKPFPPFLKECEFRLNFGTPSRQLKILRDWCGI

SEQ ID NO: 8045 - DNA, 1698 bp, Neisseria gonorrhoeae
ttgtttgaccgaatcgagaaaactatgtcccaacaatacgtctattctatgctgcgcgtgagcaaggttgtgccgccgcagaaaaccatcattaaagatatttccctttctttcttccccggcgcgaaaatcggcctcttgggcttgaacggcacgggcaagtccaccgtgctgcggattatggcgggcgtggataaagaatttgagggcgaagccgtgccgatgggcggcatcaaaatcggctatctgccgcaagagccggagcttgatccggaaaaaaccgtgcgcgaggaagtggaaagcggtttgggcgaagtggctgccgcacagaaacgtttggaagaagtgtatgccgagtacgccaatcccgatgcggattttgacgcgctggcggaagaacaaggccgcttggaagcgattatcgcggcgggttcgtcaactggcggcggtgcggaacacgaattggaaatcgctgccgacgcgctgcgcctgcctgattgggatgccaaaatcggcaatctttcgggcggtgaaaaacgccgcgtcgctttatgcaaacttttgttgagcaagcccgatatgctgctcttggacgagccgaccaaccacttggatgcggaatcggtggaatggctggagcaattcctcgtgcgcttccccggcacagtggtcgcggtaacgcacgaccgctacttcctcgacaacgccgccgaatggattttggaactcgaccgcggacacggcattccgtggaaaggcaattactcgtcttggctggagcagaaagaaaaacgcttggaaaacgaggcgaaatccgaagccgcgcgcgtgaaggcgatgaagcaggaattggaatgggtgcgccaaaatgccaaaggccgccaagccaagcccaaagcgcgtttggcgcgttttgaagaaatgagcaactacgaataccaaaaacgcaacgaaactcaggaaatctttatccctgttgccgagcgtttgggtaacgaagtgattgaatttgtgaatgtttccaaatcgttcggcgataaagtgctgattgacggtttgagcttcaaagtgccggcgggcgcgattgtcggcatcatcggcccgaacggcgcgggtaaatcgacgctgttcaaaatgattgcgggcaaagagcagcccgattcgggcgaagtgaaaatcgggcaaaccgtgaaaatgagcttgattgaccaaagccgcgaaggtttgcaaaacgacaaaaccgtgttcgacaacattgccgaaggtcgcgatattttgcaggtcggacagtttgaaatccccgcccgccaatatttgggacgcttcaactttaaaggcagcgaccaaagcaaaatcgcaaggcagctttccggcggcgaacgcggccgtctgcacttggcaaaaaccttgttgggcggcggcaatgtgttgctgctggacgaaccgtccaacgatctcgacgtggaaaccctgcgcgcgttggaagacgcattgttggaatttgccggcagcgtgatggtgatttcgcacgaccgctggtttctcgaccgcatagccacgcatatcttggcgtgtgaaggcgactccaaatgggtgttcttcgacggcaactatcaagaatacgaagccgacaagaaacgccgactcggcaaagaaggcgcgaaaccgaaacgcatcaaatacaaaccggtaacgcgt

SEQ ID NO: 8046 - protein, 566 aa, Neisseria gonorrhoeae
LFDRIEKTMSQQYVYSMLRVSKVVPPQKTIIKDISLSFFPGAKIGLLGLNGTGKSTVLRIMAGVDKEFEGEAVPMGGIKIGYLPQEPELDPEKTVREEVESGLGEVAAAQKRLEEVYAEYANPDADFDALAEEQGRLEAIIAAGSSTGGGAEHELEIAADALRLPDWDAKIGNLSGGEKRRVALCKLLLSKPDMLLLDEPTNHLDAESVEWLEQFLVRFPGTVVAVTHDRYFLDNAAEWILELDRGHGIPWKGNYSSWLEQKEKRLENEAKSEAARVKAMKQELEWVRQNAKGRQAKPKARLARFEEMSNYEYQKRNETQEIFIPVAERLGNEVIEFVNVSKSFGDKVLIDGLSFKVPAGAIVGIIGPNGAGKSTLFKMIAGKEQPDSGEVKIGQTVKMSLIDQSREGLQNDKTVFDNIAEGRDILQVGQFEIPARQYLGRFNFKGSDQSKIARQLSGGERGRLHLAKTLLGGGNVLLLDEPSNDLDVETLRALEDALLEFAGSVMVISHDRWFLDRIATHILACEGDSKWVFFDGNYQEYEADKKRRLGKEGAKPKRIKYKPVTR

SEQ ID NO: 8047 - DNA, 1194 bp, Neisseria gonorrhoeae
atggattttatgacagaggacgaacgtttcgcgtggctgcaattggcgtttacgccctatatcggcgcggaaagtttcctgctgctgatgcgcagtttcggcagcgcgcaaaatgccttgtccgcaccggcggaacaggttgccccggcggtgcggcataagcacgcgcttgaggcttggcgcaatgcggaaaaacgcgctttggcgcggcaggcggcagaagcggcgttggaatgggaaatgcgggacggatgccgcctgatgctgcttcaggatgaagatttccccgaaatgctgacgcaggggctgaccgcgccgccggttttgtttttgcgcggcaacgtgcggctgctgcacaagccttccgccgccatcgtcggcagccgccatgccacgccgcaggcgatgcggattgccaaagatttcggcagggcgttgggtgggaaaggcattcctaccgtgtcgggtatggcttcgggcatcgacaccgccgcccatcagggcgcactggaggcagaaggcggcaccgtcgccgtgtgggggacgggcatagaccgcatttatccgccggccaacaaaaaccttgcctatgaaatcgccgaaaaagggctgattgtcagcgagttccccatcggcacgcggccgtatgccggcaactttccgcgccgcaaccgcctgattgccgcgctgtcgcaggttacgctggtggtcgaggccgccttggaatccggttcgctgattaccgccggcctggcggcagaaatggggcgcgaagtgatggcggtacccggttcgatagacaacccccacagcaaaggctgccacaaactgattaaagacggagcgaaactgacggaatgtttggacgacatcctgaacgaatgcccggggctattgcaaaatacgggtgcttcgtcatattctataaataaggatacgcccgacacgggccgccgcgccgttcagacggcatacgccccgccgcctgccgcaaaaatgccgtctgaaggggcggcaggcggcacagccgtcggcggcatactggataaaatgggtttcgacccggttcatcccgacgtgcttgccggacagttggctatgcctgccgcagatttgtatgccgcactgttggaattggaattggacggcagcgttgccgcaatgcccggcggcagataccagcgtatccgaact

SEQ ID NO: 8048 - protein, 398 aa, Neisseria gonorrhoeae
MDFMTEDERFAWLQLAFTPYIGAESFLLLMRSFGSAQNALSAPAEQVAPAVRHKHALEAWRNAEKRALARQAAEAALEWEMRDGCRLMLLQDEDFPEMLTQGLTAPPVLFLRGNVRLLHKPSAAIVGSRHATPQAMRIAKDFGRALGGKGIPTVSGMASGIDTAAHQGALEAEGGTVAVWGTGIDRIYPPANKNLAYEIAEKGLIVSEFPIGTRPYAGNFPRRNRLIAALSQVTLVVEAALESGSLITAGLAAEMGREVMAVPGSIDNPHSKGCHKLIKDGAKLTECLDDILNECPGLLQNTGASSYSINKDTPDTGRRAVQTAYAPPPAAKMPSEGAAGGTAVGGILDKMGFDPVHPDVLAGQLAMPAADLYAALLELELDGSVAAMPGGRYQRIRT

SEQ ID NO: 8049 - DNA, 483 bp, Neisseria gonorrhoeae
ttggctgattttaaacctgactttgcgtggctgttgaaacggccgttgtgttttttggctttcggtttcggcagcgggctggttccgtttgcgccgggcacattcggcactttggcggcactgcctttggcgtttgtgctgattttgctcggcatagacgggctgctgctggcttttgtgtgtatcgtgctgtttatgtggggcatacgtatttgtgcgtgtgcggaacgtgaaacgggtgtcagcgaccacggtgggattgtttgggacgagattgtcgccatgctgtttgtgctggcgtttgtgccgttcaggtggacgtggtggctggcggcatttgttctgttccgtctgtttgatgcgctcaaaccgccccccgtcggttggtttgacaagaatctgcacggcggtttgggcattatggcggacgatatggcggctgcggtgatgaccttgattgtcttgaggattgcaatgctgttt

SEQ ID NO: 8050 - protein, 161 aa, Neisseria gonorrhoeae
LADFKPDFAWLLKRPLCFLAFGFGSGLVPFAPGTFGTLAALPLAFVLILLGIDGLLLAFVCIVLFMWGIRICACAERETGVSDHGGIVWDEIVAMLFVLAFVPFRWTWWLAAFVLFRLFDALKPPPVGWFDKNLHGGLGIMADDMAAAVMTLIVLRIAMLF

SEQ ID NO: 8051 - DNA, 1275 bp, Neisseria gonorrhoeae
atgcgtagcagcgatattttaattgtagacgacgaagtcggcatccgcgacctgctgtcggaaatcctgcaggacgaaggctattcggtcgcgttggcggaaaatgccgaagaggcgcgcaagctgcgccatcaggcgcgcccggcaatggtgctgctggatatttggatgcccgattgcgacggtatcacccttttgaaggagtgggcgaaaaacgggcagctcaatatgccggtggtggtgatgagcgggcatgccagcatcgataccgccgtagaagcgaccaaaatcggcgcgatcgattttttggaaaaaccgatttccctgcaaaagctgctgtctgcggtcgaaaacgcgttgaaacacggtgcggcgcaaatcgaaacgggaccggtgttcgacaaactgggcaacagtgccgcgattcaagagatgaaccgcgaagtcgaagcggcggcaaagcgcacgtcccctgtatttttgacgggcgaggcgggttcgccgtttgaaaccgtggcgcgctatttccataaaaacggtacgccgtgggtcagtccggcaagggtcgaatatctgatcgatatgccgatggaactgttgcagaaggcggagggcggcgttttgtatgtcggcgacatcgcccaatacagccgcaatatccaaaccggcattacctttatcatcggcaaggcagaacgctgccgtgtcagggtgattgcttcgtgcagctacgcggcaggttcagacggcatttcatgtgaagaaaaattggccgggcttttttcggaatcggtcgtccgtattccgcccctgagtatgcagcatgaagacattcccttcctgatacaggggattgcctgcaatgtggcggaaagccaaaaaatcacgcctaccgcattcagtgacgatgcgcttgccgtattgtcccgttacgactggccggggaatttcgagcagttgcaaaacgtcgtgacaacgctgctgctggaggcggacgggcaggaaatcggtatcggcgcggcttcttcggcactggggcgcggcgtgcctgccgacggaacggggcatatggcgtgcgggttcgactttaacctgccgctgcgcgaattaagggaggaggtggagcggcgttatttcgagtaccacatcgcccaagaaggtcagaatatgagcaaagtggcgcagaaggtcggtttggaacgcacgcacctttaccgcaaactcaaacagctcggcatcggcgtttcgcgccgggcgggggaaaaaaccgaagaa

SEQ ID NO: 8052 - protein, 425 aa, Neisseria gonorrhoeae
MRSSDILIVDDEVGIRDLLSEILQDEGYSVALAENAEEARKLRHQARPAMVLLDIWMPDCDGITLLKEWAKNGQLNMPVVVMSGHASIDTAVEATKIGAIDFLEKPISLQKLLSAVENALKHGAAQIETGPVFDKLGNSAAIQEMNREVEAAAKRTSPVFLTGEAGSPFETVARYFHKNGTPWVSPARVEYLIDMPMELLQKAEGGVLYVGDIAQYSRNIQTGITFIIGKAERCRVRVIASCSYAAGSDGISCEEKLAGLFSESVVRIPPLSMQHEDIPFLIQGIACNVAESQKITPTAFSDDALAVLSRYDWPGNFEQLQNVVTTLLLEADGQEIGIGAASSALGRGVPADGTGHMACGFDFNLPLRELREEVERRYFEYHIAQEGQNMSKVAQKVGLERTHLYRKLKQLGIGVSRRAGEKTEE

SEQ ID NO: 8053 - DNA, 924 bp, Neisseria gonorrhoeae
ttgcaaacaggtacggataaggatgtcgtattgggcataggcgacgatgcggcgattgtccgcccgcgcgaaggcttcgatttgtgtttcagtgcggatatgcttttgaaggacaggcatttttttgcagatgtcaaacctgaaggcttggcttggaaggttttggccgtcaatatttcagatatggcggcgatgggtgcgataccgcgttgggtgctgctgagcgcggcgttgcccgaattggatgaagtatggctggaacggttttgcggcagctttttcggtttggcaaaaaagtttggcgtaacgttaatcggcggcgatacgaccaagggcgatatggcgttcaatgtaaccattatcggcgaattgccgaagggtagggcgttgcggcgtgatgcggcggttgcgggcgacgatatttgggtgtcggggcgtgtcggtatggcggcggcggctttgaactgccgtctgaaacggtgtgtgttgccggatgatgtgttcgccgaatgcgaacaaaagctgctccgtcccgagccaagggttgggctggggcttgcgctgttgccgtttgcccgggcggcacaggatgtttcagacggccttgcgcaagatttggggcatatcctgaccgcttccggcgtgggggcggaaatttgggccgattcgctgccatctttatctgtattgaaagatattttgccccgagcgcaatggctgtcttatactttggcgggcggcgacgattacgagctggtttttaccgctccggaaagttgccgcagccgcgtgcttgatgcggcggaacggtgcggcgtgccggtaacgtgcatcggcaaaatcaacggaggatgccgtctgaaggttttagatgccggcggcagggaattggaactacattctttaggattcgatcattttggc

SEQ ID NO: 8054 - protein, 308 aa, Neisseria gonorrhoeae
LQTGTDKDVVLGIGDDAAIVRPREGFDLCFSADMLLKDRHFFADVKPEGLAWKVLAVNISDMAAMGAIPRWVLLSAALPELDEVWLERFCGSFFGLAKKFGVTLIGGDTTKGDMAFNVTIIGELPKGRALRRDAAVAGDDIWVSGRVGMAAAALNCRLKRCVLPDDVFAECEQKLLRPEPRVGLGLALLPFARAAQDVSDGLAQDLGHILTASGVGAEIWADSLPSLSVLKDILPRAQWLSYTLAGGDDYELVFTAPESCRSRVLDAAERCGVPVTCIGKINGGCRLKVLDAGGRELELHSLGFDHFG

SEQ ID NO: 8055 - DNA, 2151 bp, Neisseria gonorrhoeae
ttggaaacctctaaacatcatcgggaacaaataatgcgccgcttcctaccgatcgcagccatatgcgccgtcgtcctgctgtacggattgacggcggcgaccggcagcaccagttcgctggcggattatttctggtggatagtctcgttcagcgcaatgctgctgctggtgttgtccgccgttttggcacgttatgtcatattgctgttgaaagacaggcgcaacggcgtgttcggttcgcagattgccaaacgcctttccgggatgttcacgctggtcgccgtactgcccggcttgttcctgttcggcatttccgcgcagtttatcaacggcacgattaattcgtggttcggcaacgacacccacgaagccctcgaacgcagccttaatttgagcaagtccgcactggatttggcggcagacaatgccgtcagcaacgccgttcccgtacagatagacctcatcggcaccgcctccctgtcgggcaatatgggcagtgtgctggaacactacgccggcagcggttttgcccagcttgccctgtacaatgccgcaagcgggaaaatcgaaaaaagcatcaatccgcaccaattcgaccagccgcttcccgacaaagaacattgggaacagattcagcagaccggttcggttcggagtttggaaagcataggcggcgtattgtacgcgcagggatggttgtcggcaggtacgcacaacgggcgcgattacgcgctgttcttccgccagccgattcccgaaaatgtggcacaggatgccgttctgattgaaaaggcgcgggcgaaatatgccgaattgagttacagcaaaaaaggtttgcagaccttttttctggtaaccctgctgattgcctcgctgctgtcgatttttcttgcgctggtaatggcactgtattttgcccgccgtttcgtcgaacccattctgtcgcttgccgagggcgcaaaggcggtggcgcagggtgatttcagccagacgcgccccgtattgcgcaacgacgagttcggacgtttgaccaagctgttcaaccatatgaccgagcagctttccatcgccaaagaagcagacgaacgcaaccgccggcgcgaggaagccgcccgtcactacctcgagtgcgtgttggatgggttgactaccggtgtggtggtgtttgacgaaaaaggccgtttgaaaaccttcaacaaggcggcggaacagattttggggatgccgctcgcccccctgtggggcagcagccggcacggttggcacggcgtttcggcgcagcagtccctgcttgccgaagtgtttgccgccatcggtgcggcggcaggtacggacaaaccggtccaggtggaatatgccgcgccggacgatgccaaaatcctgctgggcaaggcgacggtattgcccgaagacaacggcaacggcgtggtgatggtgattgacgacatcaccgtgctgatacgcgcgcaaaaagaagccgcgtggggtgaagtggcgaagcggctggcacacgaaatccgcaatccgctcacgcccatccagctttccgccgaacggctggcgtggaaattgggcgggaagctggacgatcaggacgcgcaaatcctgacgcgttcgaccgacaccatcatcaaacaggtggcggcgttaaaagaaatggtcgaggcattccgcaattacgcgcgcgccccttcgctcaaactggaaaatcaggatttgaacgccttaatcggcgatgttttggccctgtacgaagccggcccgtgccggtttgaggcggaacttgccggcgaaccgctgatgatggcggcggatacgaccgccatgcggcaggtgctgcacaatattttcaaaaatgccgccgaagcggcggaagaagccgatatgcccgaagtcagggtaaaatcggaaacggggcaggacggacggattgtcctgacggtttgcgacaacggcaagggattcggcaaggaaatgctgcacaatgctttcgagccgtatgtgacggataagccggcgggaacgggactgggtctgcctgtagtgaaaaaaatcattggagaacacggcggccgcatcagcctgagcaatcaggatgcgggtggggcgtgtgtcagaatcatcttgccaaaaacggtagaaacttatgcg

SEQ ID NO: 8056 - protein, 717 aa, Neisseria gonorrhoeae
LETSKHHREQIMRRFLPIAAICAVVLLYGLTAATGSTSSLADYFWWIVSFSAMLLLVLSAVLARYVILLLKDRRNGVFGSQIAKRLSGMFTLVAVLPGLFLFGISAQFINGTINSWFGNDTHEALERSLNLSKSALDLAADNAVSNAVPVQIDLIGTASLSGNMGSVLEHYAGSGFAQLALYNAASGKIEKSINPHQFDQPLPDKEHWEQIQQTGSVRSLESIGGVLYAQGWLSAGTHNGRDYALFFRQPIPENVAQDAVLIEKARAKYAELSYSKKGLQTFFLVTLLIASLLSIFLALVMALYFARRFVEPILSLAEGAKAVAQGDFSQTRPVLRNDEFGRLTKLFNHMTEQLSIAKEADERNRRREEAARHYLECVLDGLTTGVVVFDEKGRLKTFNKAAEQILGMPLAPLWGSSRHGWHGVSAQQSLLAEVFAAIGAAAGTDKPVQVEYAAPDDAKILLGKATVLPEDNGNGVVMVIDDITVLIRAQKEAAWGEVAKRLAHEIRNPLTPIQLSAERLAWKLGGKLDDQDAQILTRSTDTIIKQVAALKEMVEAFRNYARAPSLKLENQDLNALIGDVLALYEAGPCRFEAELAGEPLMMAADTTAMRQVLHNIFKNAAEAAEEADMPEVRVKSETGQDGRIVLTVCDNGKGFGKEMLHNAFEPYVTDKPAGTGLGLPVVKKIIGEHGGRISLSNQDAGGACVRIILPKTVETYA

SEQ ID NO: 8057 - DNA, 597 bp, Neisseria gonorrhoeae
atggcttttattacgcgcttattcaaaagcattaaacaatggcttgtgctgttgccgatactctccgttttgccggacgcggcggcggagggcattgccgcgacccgcgccgaagcgaggataaccgacggcgggcggctttccatcagcagccgcttccaaaccgagctgcccgaccagctccaacaggcgttgcgccggggcgtaccgctcaactttaccttaagctggcagctttccgccccgacaatcgcttcttatcggtttaaattggggcaactgattggcgatgacgacaatattgactacaaactaagtttccatccgctgaccaaccgctaccgcgttaccgtcggcgcattttccaccgattacgacactttggatgcggcattgcgcgcgaccggcgcggttgccaactggaaagtcctgaacaaaggcgcgttgtccggtgcggaagcaggggaaaccaaggcggaaatccgcctgacgctgtccacttcaaaactgcccaagcctttccaaatcaacgcattgacttctcaaaactggcatttggattcgggttggaaacctctaaacatcatcgggaacaaa

SEQ ID NO: 8058 - protein, 199 aa, Neisseria gonorrhoeae
MAFITRLFKSIKQWLVLLPILSVLPDAAAEGIAATRAEARITDGGRLSISSRFQTELPDQLQQALRRGVPLNFTLSWQLSAPTIASYRFKLGQLIGDDDNIDYKLSFHPLTNRYRVTVGAFSTDYDTLDAALRATGAVANWKVLNKGALSGAEAGETKAEIRLTLSTSKLPKPFQINALTSQNWHLDSGWKPLNIIGNK

SEQ ID NO: 8059 - DNA, 141 bp, Neisseria gonorrhoeae
gtgtttcagcgtatttcacttttagctttagccataccgtacccgtatgcaccgaccaccctgtttcaacacacaaacggcatatcaaagcaccgcactgcacgccgccccgaatgcaaagcggcaacttccgccaccgat

SEQ ID NO: 8060 - protein, 47 aa, Neisseria gonorrhoeae
VFQRISLLALAIPYPYAPTTLFQHTNGISKHRTARRPECKAATSATD

SEQ ID NO: 8061 - DNA, 177 bp, Neisseria gonorrhoeae
ttgccgctttgcattcggggcggcgtgcagtgcggtgctttgatatgccgtttgtgtgttgaaacagggtggtcggtgcatacgggtacggtatggctaaagctaaaagtgaaatacgctgaaacactgaatgagccgctttattgtttgtacgacctttgctgctttgctatgatt

SEQ ID NO: 8062 - protein, 59 aa, Neisseria gonorrhoeae
LPLCIRGGVQCGALICRLCVETGWSVHTGTVWLKLKVKYAETLNEPLYCLYDLCCFAMI

SEQ ID NO: 8063 - DNA, 1257 bp, Neisseria gonorrhoeae
atgagtatggcacttgcccaaaaacttgccgccgacagcattgcggcggttgccgaagggcgcaaccttcaggacgtgttggcgcacatccgcgcggcgcatccgcagctgacggcgcaggaaaacggcgcgttgcaggatatcgcctacggctgccagcgttatttgggcagtttgaaacatatgctcgcgcagatgctgaaaaagcccatcgacaatccgcagctcgaaagcctgcttttggcggcgttgtaccaactgcattacacgcgcaacgcgccccacgccgtggtcaacgaagctgttgaaagcatagccaaaatcgggcgcgggcagtaccgttcgtttgccaacgcggttttgcgccgctttttgcgcgaacgtgaaaaattggcggcttcctgcaaaaaagacgatgtggcgaaacacaacctgccgctgtggtgggtggcttacttgaaaaaccattatccgaaacactggcacaacatcgccgccgcgctgcaatcccatccgccgatgacgttgcgcgtcaaccgccggcacggcaatgccgaaagctatttggaaaaactggtggcggaaggtatcgcggctaaggcgttggacgaatatgcggttacgttggaagaagccgtgccggtaaaccgtctgcccggttttgccgaaggactggtgtcggtacaggacttcggcgcgcagcaggcggcgtatctccttaacccgaaagacggcgaacggattttggacgcgtgcgccgcgccgggcggcaagacggggcatattttggaactggcggactgccgcgttaccgccttggacatcgatgcaggccgtctgaagcgtgtggaggacaatatcgcccgtttgggctttcagacggcatcggcggcgtgtgccgatgcgcgggatttggcggcgtggtatgatggaaagcctttcgacgcaatccttgccgacgtgccgtgcaccgcttccggcgtggcgcggcgcaatcccgacgtgaaatggctgcgccgaccgaccgacgcgctcaaaaccgcccgccagcaggaagccctgctggacgcactttggcaggcgttgaaacagggcggcagaatgctgcttgccacctgttccgtgttcgtcgaagaaaacgacgggcaactgcaaaaattcctcaaccgccatgccgatgccgaaccgatcgaatcgcgggtgcttttaccgaacaaacaccaagatggcttttattacgcgcttattcaaaagcat

SEQ ID NO: 8064 - protein, 419 aa, Neisseria gonorrhoeae
MSMALAQKLAADSIAAVAEGRNLQDVLAHIRAAHPQLTAQENGALQDIAYGCQRYLGSLKHMLAQMLKKPIDNPQLESLLLAALYQLHYTRNAPHAVVNEAVESIAKIGRGQYRSFANAVLRRFLREREKLAASCKKDDVAKHNLPLWWVAYLKNHYPKHWHNIAAALQSHPPMTLRVNRRHGNAESYLEKLVAEGIAAKALDEYAVTLEEAVPVNRLPGFAEGLVSVQDFGAQQAAYLLNPKDGERILDACAAPGGKTGHILELADCRVTALDIDAGRLKRVEDNIARLGFQTASAACADARDLAAWYDGKPFDAILADVPCTASGVARRNPDVKWLRRPTDALKTARQQEALLDALWQALKQGGRMLLATCSVFVEENDGQLQKFLNRHADAEPIESRVLLPNKHQDGFYYALIQKH

SEQ ID NO: 8065 - DNA, 186 bp, Neisseria gonorrhoeae
atgatgataaaaccatatccggcatacagtgccgcacacatcgggcacgattccatccatttcccaatgagggggaaaggcgtgaatttgtatgaattatccctttcggggcttgatacagaaaggattcccttgctatgggcaaacccacatcctaccgccttaaaatcagagtttcaaccgata

SEQ ID NO: 8066 - protein, 62 aa, Neisseria gonorrhoeae
MMIKPYPAYSAAHIGHDSIHFPMRGKGVNLYELSLSGLDTERIPLLWANPHPTALKSEFQPI

SEQ ID NO: 8067 - DNA, 201 bp, Neisseria gonorrhoeae
ttgttaatccactataaagcgcggcaatgggacacaaacatgaatctgaatccgaatccgaacctgcaccccgattctgacgatagccgtttcagaaaaccacccaaaaaaacaaaccccgcaaaagcggggtttgtttcacatcatcgataccggccgacgtttcacgaatattgcaacagtacccggtacaaaatccgc

SEQ ID NO: 8068 - protein, 67 aa, Neisseria gonorrhoeae
LLIHYKARQWDTNMNLNPNPNLHPDSDDSRFRKPPKKTNPAKAGFVSHHRYRPTFHEYCNSTRYKIR

SEQ ID NO: 8069 - DNA, 960 bp, Neisseria gonorrhoeae
ttgtccgacaactttacgcacacgcaggaacacgctatgaaagtcatctttgccggcacgcccgattttgccgccgccgccttaaaagccgttgccgccgccggttttgaaatcccgctggtgctgacccagcccgaccgtccgaaagggcgcggtatgcaactgaccgccccgcctgtcaaacaagccgcgctggaactcggtttgcgcgtggcacagcccgaaaaactgcgcaacaacgccgaagccctgcaaatgctcaaagaggtcgaggcggacgtaatggtggttgccgcgtacggcttgattctgccgcaggaagtgttggatacgccgaaacacggctgcctcaatatccacgcttcgctgctgccccgttggcgcggcgcggcgccgattcagcgcgcgattgaggccggcgatgccgaaaccggcgtgtgcattatgcagatggacatcggtttggacaccggcgatgtggtcagcgaacaccgctacgccatccaacctaccgataccgccaacgaagtccacgacgcgctgatggaaatcggtgcggcggcggttgttgccgatttgcaacagcttcaaagcaaaggccgtctgaacgcggtcaaacagcccgaagaaggcgtaacttacgcccaaaaactaagcaaagaagaagcgcgtatcgattggagcgaaagcgcggacattatcgaacgcaaaatccgcgccttcaaccccgtgcctgccgcgtgggtcgaatatcagggcaagccgatgaaaatccggcgtgccgaagtggtggcgcaacaaggtacggcaggcgaagtgttgtcctgttcggcggacggtttggtcgttgcctgcggcgaaagcgcgctgaagattaccgaattgcagcctgccggcggcaggcgtatgaatattgcggcgtttgcggcgggacggtctattgaagcaggggcgaagctg

SEQ ID NO: 8070 - protein, 320 aa, Neisseria gonorrhoeae
LSDNFTHTQEHAMKVIFAGTPDFAAAALKAVAAAGFEIPLVLTQPDRPKGRGMQLTAPPVKQAALELGLRVAQPEKLRNNAEALQMLKEVEADVMVVAAYGLILPQEVLDTPKHGCLNIHASLLPRWRGAAPIQRAIEAGDAETGVCIMQMDIGLDTGDVVSEHRYAIQPTDTANEVHDALMEIGAAAVVADLQQLQSKGRLNAVKQPEEGVTYAQKLSKEEARIDWSESADIIERKIRAFNPVPAAWVEYQGKPMKIRRAEVVAQQGTAGEVLSCSADGLVVACGESALKITELQPAGGRRMNIAAFAAGRSIEAGAKL

SEQ ID NO: 8071 - DNA, 111 bp, Neisseria gonorrhoeae
atgatatttgaaaaatcaataaacggctggaaataccgcgccgtaatggaaatcagaaccacgcaaaaggagcttgccttgaacagcctttatacaacagacaggattgaa

SEQ ID NO: 8072 - protein, 37 aa, Neisseria gonorrhoeae
MIFEKSINGWKYRAVMEIRTTQKELALNSLYTTDRIE

SEQ ID NO: 8073 - DNA, 348 bp, Neisseria gonorrhoeae
ttgggcggtttgccggaagaaggtgctcatgggaaatcccctaaatgccttggtgggaatttaggggattttaggggaattttgcaaaggtcttcgggtttgtattataagatttgggaaggtggttggagaatgcccgcgctgccgtttttcagaacatctatccctatgcttgtccaaaatcgtatggagtcgattttcaaccacaacaaagatgccattttcttggaaggatggagcttgggtgatgccgccatgattatggaacttttgtggcaaaacataagcacttcacgaagagaacttaccaaactgtttttatataaaaacttttggggttgtactaga

SEQ ID NO: 8074 - protein, 116 aa, Neisseria gonorrhoeae
LGGLPEEGAHGKSPKCLGGNLGDFRGILQRSSGLYYKIWEGGWRMPALPFFRTSIPMLVQNRMESIFNHNKDAIFLEGWSLGDAAMIMELLWQNISTSRRELTKLFLYKNFWGCTR

SEQ ID NO: 8075 - DNA, 342 bp, Neisseria gonorrhoeae
atgggcttaaagtgtctgcccgaaagacgtttaatcacacaaggaaaccaaaaaatgaacatccaacttcaaggccacatcgtcggcgttaaaaaattcaacggacaaatcgaaggcaagagcttcgactattgccgcctgattgtcgccacacccttagacagctcccaaggcaacgcattgggcagctctactactgaatacgatttcggcggctctgccaatttcgagcagttccgaaacgcccaatttccgatcgaagcaaacctgaacgtggaaatcgtcactacgggcaaaactcaaaaactgaaagtcatcggttttcaactcgttaagaaaggc

SEQ ID NO: 8076 - protein, 114 aa, Neisseria gonorrhoeae
MGLKCLPERRLITQGNQKMNIQLQGHIVGVKKFNGQIEGKSFDYCRLIVATPLDSSQGNALGSSTTEYDFGGSANFEQFRNAQFPIEANLNVEIVTTGKTQKLKVIGFQLVKKG

SEQ ID NO: 8077 - DNA, 510 bp, Neisseria gonorrhoeae; identical to SEQ ID NO: 103

SEQ ID NO: 8078 - protein, 170 aa, Neisseria gonorrhoeae; identical to SEQ ID NO: 104

SEQ ID NO: 8079 - DNA, 96 bp, Neisseria gonorrhoeae
ttgtttcacatcatcgataccggccgacgtttcacgaatattgcaacagtacccggtacaaaatccgctaacctcatgcatcggcaagatattacc

SEQ ID NO: 8080 - protein, 32 aa, Neisseria gonorrhoeae
LFHIIDTGRRFTNIATVPGTKSANLMHRQDIT

SEQ ID NO: 8081 - DNA, 708 bp, Neisseria gonorrhoeae
atgaccaaacagctgaaattaagcgcattattcgttgcattgctcgcttccggcactgctgttgcgggcgaggcgtccgttcagggttacaccgtaagcggccaatcgaacgaaatcgtacgcaacaactatggagaatgctggaaaaacgcctactttgataaagcaagccaaggtcgcgtagaatgcggcgatgcggttgccgtccccgagcccgaacccgcgcctgtcgccgttgtggagcaggctcctcaatatgttgatgaaaccatttccctgtctgccaaaaccctgttcggtttcgataaggattcattgcgcgccgaagctcaagacaacctgaaagtattggcgcaacgcctgagtcgaaccaatgtccaatctgtccgcgtcgaaggccataccgactttatgggttctgaaaaatacaatcaggctctgtccgaacgccgcgcatacgtagtggcaaacaacctggtcagcaacggcgtacctgcttctagaatttctgctgtcggcttgggcgaatctcaagcgcaaatgactcaagtttgtcaagccgaagttgccaaactgggtgcgaaagcctctaaagccaaaaaacgtgaggctctgattgcatgtatcgaacctgaccgccgcgtagatgtgaaaatccgcagcatcgtaacccgtcaggttgtgccggcacgcaatcatcaccaacac

SEQ ID NO: 8082 - protein, 236 aa, Neisseria gonorrhoeae
MTKQLKLSALFVALLASGTAVAGEASVQGYTVSGQSNEIVRNNYGECWKNAYFDKASQGRVECGDAVAVPEPEPAPVAVVEQAPQYVDETISLSAKTLFGFDKDSLRAEAQDNLKVLAQRLSRTNVQSVRVEGHTDFMGSEKYNQALSERRAYVVANNLVSNGVPASRISAVGLGESQAQMTQVCQAEVAKLGAKASKAKKREALIACIEPDRRVDVKIRSIVTRQVVPARNHHQH

SEQ ID NO: 8083 - DNA, 543 bp, Neisseria gonorrhoeae
atgaaaaacaggcggcgtatccgccgaaggaaagagaaaattatggctttactgaatatcttgcaatatcccgacgagcgtctgcacacggtggcaaagcctgtcgaacaagttgacgagcgcatccggaagctggttgccgatatgtttgaaacgatgtacgaatcgcgcggcatcgggctggcggcgacgcaggtcgatgtgcacgaacgcgtggtcgtgatggatttgaccgaagaccgcagcgaaccgcgcgtgttcatcaaccccgtcatcgttgaaaaagacggcgaaaccacttacgaagagggctgcctgtccgtaccgggcatttacgacgccgttacccgcgccgaacgcgtcaaggtcgaggctttgaacgaaaaaggcgaaaaattcacgctggaggcggacgggctgctggcgatttgcgtgcagcacgagttagatcacctgatgggcatcgtgtttgtcgaacgcctttcccaactcaagcaggggcggattaagaccaaactgaaaaaacgtcagaaacatacgatt

SEQ ID NO: 8084 - protein, 181 aa, Neisseria gonorrhoeae
MKNRRRIRRRKEKIMALLNILQYPDERLHTVAKPVEQVDERIRKLVADMFETMYESRGIGLAATQVDVHERVVVMDLTEDRSEPRVFINPVIVEKDGETTYEEGCLSVPGIYDAVTRAERVKVEALNEKGEKFTLEADGLLAICVQHELDHLMGIVFVERLSQLKQGRIKTKLKKRQKHTI

SEQ ID NO: 8085 - DNA, 150 bp, Neisseria gonorrhoeae; identical to SEQ ID NO: 7177

SEQ ID NO: 8086 - protein, 50 aa, Neisseria gonorrhoeae; identical to SEQ ID NO: 7178

SEQ ID NO: 8087 - DNA, 138 bp, Neisseria gonorrhoeae
gtgtgggtctgtgtcgggtggctgaacattgtttataatttatcatattttcttgccggtacggtatggggctttgccgttgtgtttgttgtttttgtgcaacggcaatcgtgcgatatggaaaaaatccccctaaag

SEQ ID NO: 8088 - protein, 46 aa, Neisseria gonorrhoeae
VWVCVGWLNIVYNLSYFLAGTVWGFAVVFVVFVQRQSCDMEKIPLK

SEQ ID NO: 8089 - DNA, 153 bp, Neisseria gonorrhoeae
atggctttactgaatatagagcagggttataatacgacgttgcataaccgttccccttatctgataaatttcggtttgtcttgcttgattgggttggaaaaagcggcggcagcccctcgggatgtgccgtgtgataacaaatgttccgcattt

SEQ ID NO: 8090 - protein, 51 aa, Neisseria gonorrhoeae
MALLNIEQGYNTTLHNRSPYLINFGLSCLIGLEKAAAAPRDVPCDNKCSAF

SEQ ID NO: 8091 - DNA, 948 bp, Neisseria gonorrhoeae
atgaaattacaacaattgaaatacgccttagaagtttaccggcacaacctgaacgtttccgaagcggccgaagccttattcacatcacaacccggcatctccaaacaaatcaaattgctggaagaagaaatcggcattcagatttttatccgcagcggcaagcgcgtggtttcggtctcgcagccgggcaaggtggttttggatattgcggaacgtattttgcgcgatgtacagaacattaaaaatatcggcagcgagtttaccggacaggacagcggttcgctgacggttgccacgacgcatacgcaggcgcgctatgccctaccgttgattgttgccgattttgtgaaacgctatccgaaagtcaatctgaccatcaaacagggaagccctgccgccatcgcccaaatggttacttcgggagaatctgatttggcgattgttacggaacggatagacgaccaccccgagttgggaaggctttcctgctacgactggacacacgcggtgattgtgccgaacgaccatccgctgctcgaatgcaggaatcccctccgtattgaagatttggcgaggtttccgctgattacttatgaatttgcattcaatgcgggcagcagcatcgcgcgggcattcgccaaagcccgtttggaacggccggatgtcgcattggcggcggcggatacggatgtattgaagacttatgtgcgcttgggtttgggcgtgggactgatggcgaaaatggcatacaacccggatacggacggcgatttgcagcttgtggatgcggcacacctgttcgagccgtcgccgacgtggatagctttgcgcagcgatacttatttgcgcggatatgcctacgactttatccaagcgtttgcgccgcacctgacacgcgagaaggtggataggattctgtacacgcccatcagcgaggatttttcgatt

SEQ ID NO: 8092 - protein, 316 aa, Neisseria gonorrhoeae
MKLQQLKYALEVYRHNLNVSEAAEALFTSQPGISKQIKLLEEEIGIQIFIRSGKRVVSVSQPGKVVLDIAERILRDVQNIKNIGSEFTGQDSGSLTVATTHTQARYALPLIVADFVKRYPKVNLTIKQGSPAAIAQMVTSGESDLAIVTERIDDHPELGRLSCYDWTHAVIVPNDHPLLECRNPLRIEDLARFPLITYEFAFNAGSSIARAFAKARLERPDVALAAADTDVLKTYVRLGLGVGLMAKMAYNPDTDGDLQLVDAAHLFEPSPTWIALRSDTYLRGYAYDFIQAFAPHLTREKVDRILYTPISEDFSI

SEQ ID NO: 8093 - DNA, 117 bp, Neisseria gonorrhoeae
atgttccgcattttaacatcgaattatccgtaccatcacggtaattatgaaaaacaggcggcgtatccgccgaaggaaagagaaaattatggctttactgaatatagagcagggtta

SEQ ID NO: 8094 - protein, 39 aa, Neisseria gonorrhoeae
MFRILTSNYPYHHGNYEKQAAYPPKERENYGFTEYRAGL

SEQ ID NO: 8095 - DNA, 1335 bp, Neisseria gonorrhoeae; identical to SEQ ID NO: 7191

SEQ ID NO: 8096 - protein, 445 aa, Neisseria gonorrhoeae; identical to SEQ ID NO: 7192

SEQ ID NO: 8097 - DNA, 162 bp, Neisseria gonorrhoeae
atgcaaaaccctgatttagtcggacaaaatgccttttatccgatggaatcggtttccgcccgaacggaaatcacagcggctgtctcccttgcagacagatatagcgaattaacaaaaaccggtacggcgttgccccgccccggctcaaagggaacgattccc

SEQ ID NO: 8098 - protein, 54 aa, Neisseria gonorrhoeae
MQNPDLVGQNAFYPMESVSARTEITAAVSLADRYSELTKTGTALPRPGSKGTIP

SEQ ID NO: 8099 - DNA, 786 bp, Neisseria gonorrhoeae
atgtgtcaacaagcacataatcgggatggggcaaaacacacgaaaaggtacggtatggcttcgcataatactacacatcagatgaaaacgctgtgttcttcctgttctttgcgggaactctgcctgcctgtcgggctgctgcccaacgagttcagccaactcgatgccgtcatccgccaaagccgccgcctgaaaaaaggcgaatacctgttccgtgccggcggagcctttacctcgctctttgccatccgttcgggcttcttcaaaacaaccgtcgccagtcaggacggccgcgatcaggtaacgggtttctttatgtcgggcgaactcatcggcatggacggcatctgttcctatgtgcacagttgcgacgcggtcgccttggaaaacagcgaggtatgcgagttgccgtttacccatatcgaagagctcggtcagaatatccccagcctgcgtacacactttttccgcatgataagccgcgaaattgtgcgcgatcaaggtgttatgctgttgttgggcaatatgcgcgccgaagagcggattgccgccttcctgttgaacctttcccaacgcctttattcccgaggtttcgccgccaacgacttcatcttaagaatgtcccgcgaagaaatcggcagttatctcgggctgaaacttgaaaccgtcagccgcacattatccaagttccatcaggaaggattgatttccgtcgaacacaaacacatcaagattctcaatctgcaggtgctgaaaaaaatggtatccggttgttcgcacgccatt

SEQ ID NO: 8100 - protein, 262 aa, Neisseria gonorrhoeae
MCQQAHNRDGAKHTKRYGMASHNTTHQMKTLCSSCSLRELCLPVGLLPNEFSQLDAVIRQSRRLKKGEYLFRAGGAFTSLFAIRSGFFKTTVASQDGRDQVTGFFMSGELIGMDGICSYVHSCDAVALENSEVCELPFTHIEELGQNIPSLRTHFFRMISREIVRDQGVMLLLGNMRAEERIAAFLLNLSQRLYSRGFAANDFILRMSREEIGSYLGLKLETVSRTLSKFHQEGLISVEHKHIKILNLQVLKKMVSGCSHAI

SEQ ID NO: 8101 - DNA, 648 bp, Neisseria gonorrhoeae
atgatgatgcacgcttctgtccaaagtcgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggtgcgttcaaaggctaaggcagaaaagttctaccgcgaaaaaatgatacagaacgaaagcatacaccccgtcctgcacgcttctttgcaacacttggaacacaagccgcaaatgctcgccctgctggtcaaaaaccacggcaaaggcatggcggaacaggtcaggttcaaggcggaagtgctgcccgacgacgaagacgcgcgcacgattgccgccgagttggcaaaaatggatatgttcgcattggggacggacgcggtcgcctcgggcgaaacctatgggcgcgtgttcgccgatattttcgagttgtcggcggctttggaagggcgcgcgttcaaagggatactgaaactgacggcggaatataaaaaacatcttcggcgatgcctgccgttcggaaacggcgttggatttgggcgcgctcaatcaggcgttgagggaaatctcgaaaacaccggaaaagcc

SEQ ID NO: 8102 - protein, 216 aa, Neisseria gonorrhoeae
MMMHASVQSRFAPILYVLIFFAGFLTAQIWFNQKAYTEELPPLLSALSAVALVWLAWAFVSVRSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALEGRAFKGILKLTAEYKKHLRRCLPFGNGVGFGRAQSGVEGNLENTGKA

SEQ ID NO: 8103 - DNA, 384 bp, Neisseria gonorrhoeae
ttgcaaattctgttcagttataccatttatacagacaggagcaaaccaatgacgaagttatacgcagaaatcgccgagatggaggcgcaggacgacggcacggtcaaagtttggggttatgcctcaagcgaggcggtcgattcggacggcgaagtcatcgcggcggctatgaaggcggcgattcccgattatatgaagttcggcgaggtgcgcgagatgcacggcagcaacgcggcgggaacggcgattgaaatcaacgtggaagacgacggcagaacctttttcggggcgcatatcgtcgatcccgttgcagtgaagaaagtcaaaacgggcgtttacaagggcttttccatcggcggcagcgttaccgctgtctgcttaggt

SEQ ID NO: 8104 - protein, 128 aa, Neisseria gonorrhoeae
LQILFSYTIYTDRSKPMTKLYAEIAEMEAQDDGTVKVWGYASSEAVDSDGEVIAAAMKAAIPDYMKFGEVREMHGSNAAGTAIEINVEDDGRTFFGAHIVDPVAVKKVKTGVYKGFSIGGSVTAVCLG

SEQ ID NO: 8105 - DNA, 447 bp, Neisseria gonorrhoeae
atgagcaccttcttccggcaaaccgcccaagccatgactgccaaacacatcggccgcttcccgctatcggagttggaccaggtgattgattggcagccgatcgaacaatacctgatccgtcaaaaaacccgttacctccgagaccgccgcggccgtcccgcccatcccctgtcgtccatgttcaaagccgtcctgcccggacaatggcacagcctctccgatcccgaactcgaacacagcctcatcacccgcatcggtttcaacctgttttgccgttttgacggaccgggcatccccggttgcagcaccttatgccgctaccgtaaattccgctatgcgcgggcagcctatttcgggctgctcaaagtgggtgcgcaaagccacctgaaggcgatgtgtttgaacctgttgaaagccgccaacaggctaagtgcgcccgctgccgcc

SEQ ID NO: 8106 - protein, 149 aa, Neisseria gonorrhoeae; identical to SEQ ID NO: 7978

SEQ ID NO: 8107 - DNA, 1419 bp, Neisseria gonorrhoeae
atgaaaatcattcagatacagaacaatcacaatgtaaacgatgaccgccccgagtttgaccgcgcgctgattgccagcctgcccgccagcggcccgcgctatacttcctaccctaccgccgaccgtttccatgacggtttccgcgaaggcgaatatatcaaagttttacatttgcgcggtatgggcgcgttaaacaaaccgctttccctttacattcacattccgttttgcaacaccatctgctactactgcggctgcaacaaaatcatcaccaaagacaaaagccgcgccgatacctacatcgaatatcttgaaaaagaaatggaactgctcgctccacatctgaacggacggcaccagcttgcccaactgcacttcggcggcggcacgccgacctttttgagcgacgaacagatcgaacgtgtcttccgcatgatccgcaaacatttcgaactgataccgtccggcgaatattccatcgaaatcgacccgcgcaaagtcagccgcgacaccgtcctcatgctcggcagactcggcttcaaccgcatgagcgtcggcattcaggatttcgaccccaaagtgcaggcggcagtcaaccgcatccaaagctacgaagaaaccaaagaagtcatcgatgccgcccgtgaggcagggttcaaatccgtcagcgtcgatttgatttacggcttgccgcatcagacttccgaaagcatcaaaaccaccatagataccgttttgtcgctcgatcccgaccgcctcgccctttaccactacgcccacctgccgcacgtgttcaaaccgcaacgccgcatcgataccgccgccgtccccgacagcgaagagaagctcgatatgctgcaatactgcgtccaaaccctgacagagcgcggctacgtcttcatcggcatggaccatttcgccaaacctgacgacgaactctccatcgccctcaaagaaggcttcctccaacgcaacttccaaggctattcgacctacgcggattgcgatttggtcgccatcggcgtgtcgtccatcggcaaaatcggcagcacctattcccaaaacgaacgcgacatcgatgcctactatgccgccatcgacgaaggcagactgcccatcatgcgcggctaccagctcaatcaggacgacatcctgcgccgcaacatcattcaggatttaatgtgccgcttcgcgctcgactacaggatttacgaaagtatgttcggcatcccgttcgaccgctacttcaaagacgaactggcggatttggaaaaactcgccggtttgggattggtgcgcctgaacagccacgggctgaccgttacaccgaaaggacgcttcctcatccgcaacatcgccatggtcttcgactaccacctgcgccacaaagaaaccaaagcgaaatattcgcaaacggtg

SEQ ID NO: 8108 - protein, 473 aa, Neisseria gonorrhoeae
MKIIQIQNNHNVNDDRPEFDRALIASLPASGPRYTSYPTADRFHDGFREGEYIKVLHLRGMGALNKPLSLYIHIPFCNTICYYCGCNKIITKDKSRADTYIEYLEKEMELLAPHLNGRHQLAQLHFGGGTPTFLSDEQIERVFRMIRKHFELIPSGEYSIEIDPRKVSRDTVLMLGRLGFNRMSVGIQDFDPKVQAAVNRIQSYEETKEVIDAAREAGFKSVSVDLIYGLPHQTSESIKTTIDTVLSLDPDRLALYHYAHLPHVFKPQRRIDTAAVPDSEEKLDMLQYCVQTLTERGYVFIGMDHFAKPDDELSIALKEGFLQRNFQGYSTYADCDLVAIGVSSIGKIGSTYSQNERDIDAYYAAIDEGRLPIMRGYQLNQDDILRRNIIQDLMCRFALDYRIYESMFGIPFDRYFKDELADLEKLAGLGLVRLNSHGLTVTPKGRFLIRNIAMVFDYHLRHKETKAKYSQTV

SEQ ID NO: 8109 - DNA, 204 bp, Neisseria gonorrhoeae
ttgcggctaacgtacaaaagccgtctgaaaggctttttcagacggcattttgctgccgaggataagtgttttcaagaacaggcggcggcatatcataacctttgtgtccgaccgttccgaaaccaagataccaaacagcatatcccgacagaacagattgtgcataaggcacaagcccgcacattccatcaacaaaatgccgtc

SEQ ID NO: 8110 - protein, 68 aa, Neisseria gonorrhoeae
LRLTYKSRLKGFFRRHFAAEDKCFQEQAAAYHNLCVRPFRNQDTKQHIPTEQIVHKAQARTFHQQNAV

SEQ ID NO: 8111 - DNA, 354 bp, Neisseria gonorrhoeae
ttgcactacggcaacgcggtaaccgtgggcttcaacctgcccagcaaaacccagggcagcaaagacatcatcaaaatcaaaggcgtgtgcttggacgataaagccgccgaccgcctcgccctgttcgcccccgaagcggtggtcaacaccatcgacaatttcaaggtcgtacagaagcggcatttgaccctgcccgacgaaatcgccgaagtgttccgctgcccgaatcccaattgcgccggccacggcgagccggtcaaaagccggttttatgttaagaaacacaacgggcagacgcggctgaaatgccactactgcgaaaaaacctacaaccgggattcggtggcggaagcc

SEQ ID NO: 8112 - protein, 118 aa, Neisseria gonorrhoeae
LHYGNAVTVGFNLPSKTQGSKDIIKIKGVCLDDKAADRLALFAPEAVVNTIDNFKVVQKRHLTLPDEIAEVFRCPNPNCAGHGEPVKSRFYVKKHNGQTRLKCHYCEKTYNRDSVAEA

SEQ ID NO: 8113 - DNA, 186 bp, Neisseria gonorrhoeae
ttgttgatggaatgtgcgggcttgtgccttatgcacaatctgttctgtcgggatatgctgtttggtatcttggtttcggaacggtcggacacaaaggttatgatatgccgccgcctgttcttgaaaacacttatcctcggcagcaaaatgccgtctgaaaaagcctttcagacggcttttgtacgt

SEQ ID NO: 8114 - protein, 62 aa, Neisseria gonorrhoeae
LLMECAGLCLMHNLFCRDMLFGILVSERSDTKVMICRRLFLKTLILGSKMPSEKAFQTAFVR

SEQ ID NO: 8115 - DNA, 918 bp, Neisseria gonorrhoeae
atgcctaatccgctttacagacagcacatcatctccatttcggatttgtcgcgcgaacagttggaatacctgcttcagacggcattgaagctgaaggcgcatccgcgcggcgatttgttggaaggcaaactcatcggttcgtgctttttcgagccgtccacgcgcacgaggctgtcgtttgaaacggcggtgcagcgtttgggcggtaaggtcatcggcttttcggacggcgcgaataccagtgccaaaaaaggcgaaacgcttgccgataccgcccgtatcatttccggctacaccgacgcgattgtccaacgccatcccaaagacggcgcggcgcgcgtggcggcggagttttcgcgcgtccccgtcatcaacgccggcgacggcacgaaccaacaccccagccaaaccttgttggacctggtaacgatttatgaaacgcaggggcgtttggacaagcttaaaatcgccatggcgggcgacttgaaatacgggcgcaccgtgcattcgctgtgtcaggcgttgaaacgctggggctgcgaatttgccttcgtctcgccgcccagcctcgcgatgcccgactacattaccgaagagttggaagaagccgactgccgataccgcgccctcggcagtttggaagaggcggcggaatgggcggacatcctgtatatgacccgcgtccagcgcgaacgtttcgacgaacaggaatttgccaaaatccaaggcaaattcaacctcgaagcgtctatgctcgcccgcgccaaaccgaacctgcgcgtgctgcaccccctgccgcgcacggacgaaatccaccccgatgtcgatgccgcgccgcacgcctattatttcgagcaggcgaccaacggcgtttatgcgcgtatggcgatattgtcgctggtgttgaacgaagaagtg

SEQ ID NO: 8116 - protein, 306 aa, Neisseria gonorrhoeae
MPNPLYRQHIISISDLSREQLEYLLQTALKLKAHPRGDLLEGKLIGSCFFEPSTRTRLSFETAVQRLGGKVIGFSDGANTSAKKGETLADTARIISGYTDAIVQRHPKDGAARVAAEFSRVPVINAGDGTNQHPSQTLLDLVTIYETQGRLDKLKIAMAGDLKYGRTVHSLCQALKRWGCEFAFVSPPSLAMPDYITEELEEADCRYRALGSLEEAAEWADILYMTRVQRERFDEQEFAKIQGKFNLEASMLARAKPNLRVLHPLPRTDEIHPDVDAAPHAYYFEQATNGVYARMAILSLVLNEEV

SEQ ID NO: 8117 - DNA, 1410 bp, Neisseria gonorrhoeae; identical to SEQ ID NO: 7225

SEQ ID NO: 8118 - protein, 470 aa, Neisseria gonorrhoeae; identical to SEQ ID NO: 7226

SEQ ID NO: 8119 - DNA, 840 bp, Neisseria gonorrhoeae; identical to SEQ ID NO: 7231

SEQ ID NO: 8120 - protein, 280 aa, Neisseria gonorrhoeae; identical to SEQ ID NO: 7232

SEQ ID NO: 8121 - DNA, 1572 bp, Neisseria gonorrhoeae
atggctcaaatccaaatgagcgcaaatgttaaaaccatcaacgccgtctttgccgccatgctggtaggtacagtcggctattttatttattggggcttgggttatacccattacaattacgccgccttattcattattgccacgatgttcggtgtgtttatggcgttcaacatcggcggcaacgatgttgccaattctttcggcaccagcgtcggtgcaggcacgctgaccatcccgcaggctttgctgattgcggcggtatttgaggtcagcggcgcggtcatcgcgggcggcgaggtaaccgataccatacgcaaaggcatcgtcgatttgaagggtgttgatttcgaacccatacagtttgtgtttattatgatgtccgcgcttttggcggcggcgttgtggctgctgttcgcgtcccgcaaaggcctgccggtttcgacgacgcacgcgattatcggcggcatcgtcggcagtgcgttgtgtatggcgtttacgcataatgcggacggggtggcgttgatacggtggggcaagctgggcgaaatcgggatgtcttgggtattgtcgcccgtgttgggcggcgcggtgtcctatttcctgttttcgcgcgtcaagaaaaacgtcttagattacaacgcttgggcggaaggaacgctcaagggcatcaagcaggaaaaaaaggcctataaagaacggcaccgcctgtttttcgagggtttgtccgaagccgaaaaagtcgagtacgccaccaaaatggcgcacgacgcgcaaatttacgacgaacccgaattcgatcctcaagagctgcaatcggagtattaccgcggtctttatgcgttcgacaaccgtaaaaacaatgtcgattcctacaaggcgctgcattcttggattccctttatcgcttcgttcggcacgatgatgatttccgctatgctgattttcaagggcttgaaaaacctgcatttggggatgagcaacgtcaacagcttcctgaccatctttatgataggcgcggcggtgtggatggggacgtttgtgtttgccaaaagcctcaagcgtaaagacttgggcaaatcgacctttcagatgttttcatggatgcaggtctttaccgcctgcggcttcgcattcagccacggtgcgaacgatatcgccaacgccatcggcccgtttgccgcgattatggatgttttgcggacgaacagcgttgccgcgcaaagcgccgtccctccgattgcgatgctgactttcggcatcgcgctgattgtcggtttgtggtttgtcggtaaagaggtgattaaaaccgtcggtacgagtttggcggaaatgcatcctgcttcgggttttaccgccgaactgtccgccgcatccgtcgtgatgggcgcgtcgctgatggggctgcccgtgtccagtacgcatatcttggtcggcgcggtactcggtatcggtctggtcaaccgcaatgccaactggaaactgatgaaacccatcggtttggcgtgggtcattaccctgcctgccgccgctgtattgtcgatggccagctatttgattttgcaggcagtgttc

SEQ ID NO: 8122 - protein, 524 aa, Neisseria gonorrhoeae
MAQIQMSANVKTINAVFAAMLVGTVGYFIYWGLGYTHYNYAALFIIATMFGVFMAFNIGGNDVANSFGTSVGAGTLTIPQALLIAAVFEVSGAVIAGGEVTDTIRKGIVDLKGVDFEPIQFVFIMMSALLAAALWLLFASRKGLPVSTTHAIIGGIVGSALCMAFTHNADGVALIRWGKLGEIGMSWVLSPVLGGAVSYFLFSRVKKNVLDYNAWAEGTLKGIKQEKKAYKERHRLFFEGLSEAEKVEYATKMAHDAQIYDEPEFDPQELQSEYYRGLYAFDNRKNNVDSYKALHSWIPFIASFGTMMISAMLIFKGLKNLHLGMSNVNSFLTIFMIGAAVWMGTFVFAKSLKRKDLGKSTFQMFSWMQVFTACGFAFSHGANDIANAIGPFAAIMDVLRTNSVAAQSAVPPIAMLTFGIALIVGLWFVGKEVIKTVGTSLAEMHPASGFTAELSAASVVMGASLMGLPVSSTHILVGAVLGIGLVNRNANWKLMKPIGLAWVITLPAAAVLSMASYLILQAVF

SEQ ID NO: 8123 - DNA, 234 bp, Neisseria gonorrhoeae; identical to SEQ ID NO: 7239

SEQ ID NO: 8124 - protein, 78 aa, Neisseria gonorrhoeae; identical to SEQ ID NO: 7240

SEQ ID NO: 8125 - DNA, 234 bp, Neisseria gonorrhoeae
gtggaaaaatattataatgcgcccgcaacatccagtagtagaagtgtcatacaaaccgtttccggcagcagttttgcattcggtcaggtttgggggtattcggatgcggttcagaaggaaggatgcgtctgccatatcccgaaacggcagttcgaccggaggcagcaatacagtgtcggcaacactcatgatttccaccacattaaaggaagattgccatggctcaaatccaaa

SEQ ID NO: 8126 - protein, 78 aa, Neisseria gonorrhoeae
VEKYYNAPATSSSRSVIQTVSGSSFAFGQVWGYSDAVQKEGCVCHIPKRQFDRRQQYSVGNTHDFHHIKGRLPWLKSK

SEQ ID NO: 8127 - DNA, 129 bp, Neisseria gonorrhoeae
ttgcgggcgcattataatatttttccacccgtcttaaaacatttatttacactttatttacactgcggcggcaaatcggtatacgagcgtcaatacacgttaaaatggcgttttgcaccagtttgggag

SEQ ID NO: 8128 - protein, 43 aa, Neisseria gonorrhoeae
LRAHYNIFPPVLKHLFTLYLHCGGKSVYERQYTLKWRFAPVWE

SEQ ID NO: 8129 - DNA, 588 bp, Neisseria gonorrhoeae; identical to SEQ ID NO: 7253

SEQ ID NO: 8130 - protein, 196 aa, Neisseria gonorrhoeae; identical to SEQ ID NO: 7254

SEQ ID NO: 8131 - DNA, 1128 bp, Neisseria gonorrhoeae
atggcgttttgcaccagtttgggagtgatgatggaaacacagctttacatcggcattatgtcgggaaccagtatggacggggcggatgccgtgctggtacggatggacggcggcaaatggctgggcgcggaagggcacgcctttaccccctaccctgaccggttgcgccgcaaattgctggatttgcaggacacaggcacagacgaactgcaccgcagcaggatgttgtcgcaagaactcagccgcctgtacgcgcaaaccgccgccgaactgctgtgcagtcaaaacctcgctccgtgcgacattaccgccctcggctgccacgggcaaaccgtccgacacgcgccggaacacggttacagcatacagcttgccgatttgccgctgctggcggaactgacgcggatttttaccgtcggcgacttccgcagccgcgaccttgctgccggcggacaaggtgcgccgctcgtccccgcctttcacgaagccctgttccgcgatgacagggaaacacgcgtggtactgaacatcggcgggattgccaacatcagcgtactcccccccggcgcacccgccttcggcttcgacacagggccgggcaatatgctgatggacgcgtggacgcaggcacactggcagctgccttacgacaaaaacggtgcaaaggcggcacaaggcaacatattgccgcaactgctcggcaggctgctcgcccacccgtatttctcacaaccccacccaaaaagcacggggcgcgaactgtttgccctaaattggctcgaaacctaccttgacggcggcgaaaaccgatacgacgtattgcggacgctttcccgattcaccgcgcaaaccgtttgcgacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatcctcaatgggtggaggcggccgcatttgcgtggttggcggcgtgttggattaaccgcattcccggtagtccgcacaaagcgaccggcgcatccaaaccgtgtattctgggcgcgggatattattat

SEQ ID NO: 8132 - protein, 376 aa, Neisseria gonorrhoeae
MAFCTSLGVMMETQLYIGIMSGTSMDGADAVLVRMDGGKWLGAEGHAFTPYPDRLRRKLLDLQDTGTDELHRSRMLSQELSRLYAQTAAELLCSQNLAPCDITALGCHGQTVRHAPEHGYSIQLADLPLLAELTRIFTVGDFRSRDLAAGGQGAPLVPAFHEALFRDDRETRVVLNIGGIANISVLPPGAPAFGFDTGPGNMLMDAWTQAHWQLPYDKNGAKAAQGNILPQLLGRLLAHPYFSQPHPKSTGRELFALNWLETYLDGGENRYDVLRTLSRFTAQTVCDAVSHAAADARQMYICGGGIRNPVLMADLAECFGTRVSLHSTAELNLDPQWVEAAAFAWLAACWINRIPGSPHKATGASKPCILGAGYYY

SEQ ID NO: 8133 - DNA, 228 bp, Neisseria gonorrhoeae
gtgcttgggcgtcttagggaaccgttccctttgggccggggcggggcaacgccgtactggtttttgttaatccactataaaagcaaagaaaccgccattagcactacacccccccaagctgcggctgccaaacacatcggctgcttctcgacgcacccgctgaaaaatgcgccctatccgcccgccttgaccgcaccccctgcctttgccaccctgcccgatgccgtc

SEQ ID NO: 8134 - protein, 76 aa, Neisseria gonorrhoeae
VLGRLREPFPLGRGGATPYWFLLIHYKSKETAISTTPPQAAAAKHIGCFSTHPLKNAPYPPALTAPPAFATLPDAV

SEQ ID NO: 8135 - DNA, 444 bp, Neisseria gonorrhoeae
aacctttccggcaacaaaagacaagatgtcggccgcaatcagcggcccgacagggataccgcccataaatgccaccccgatgaccgtaccgatcagcaagcccgttaccaataccggctgccgtcccatcaaaggcacgccgcatcccgccagccaagccacgaaaataccgataaaaacggcggatatcattttaaaattcaaaaattcggcaacaggaggaacctgcgcctttcctgaaaccaacggactcaaaacccctatggtcaaaagaatgataccgaggttcaacccgtgcttctcgaccaacgggacaaactgtaccaatgccgtctgctgcatcagcagcaatatggttgccgagacggtaatcgaattgttgttgctgaccacccccaacagaatcagcgtaaccagaaacaggggaacaaaactgaaattcat

SEQ ID NO: 8136 - protein, 79 aa, Neisseria gonorrhoeae
NLSGNKRQDVGRNQRPDRDTAHKCHPDDRTDQQARYQYRLPSHQRHAASRQPSHENTDKNGGYHFKIQKFGNRRNLRLS

SEQ ID NO: 8137 - DNA, 549 bp, Neisseria gonorrhoeae
atgaaggttttgaacggttggtcagataggaagatgtggcgggttttgagtgctttgccgataggcgtggtgttttttgatttgatctacggttttgtgttgaatgtgttgcagggtttggatttgcagcgtgccgtgccggattcggaaggcgtgttggcggttacgcccgatattgcgttcaacagtttgcagattgtcgccaacggcggtatggcggcggtggtctgtttcgggttggcggttgtgtttttgctcaaccgttcggtgcggcggcggcaggtcttggaaatcggggtgttccggatgttggggctggtggcggtattggcgttcagcgcgccttcgctgtgggagtgggcgaacgcgctgccgctgctgctgaagggcgcggacgtggtcaatacggggaatgcgcgttatgtgctgacggctttgtgtatgccctttccggcggtgtcgtgcatcatcgggctggtagggcggttcaggcttcagacggcatcgggcagggtggcaaaggcagggggtgcggtcaaggcgggcgga

SEQ ID NO: 8138 - protein, 183 aa, Neisseria gonorrhoeae
MKVLNGWSDRKMWRVLSALPIGVVFFDLIYGFVLNVLQGLDLQRAVPDSEGVLAVTPDIAFNSLQIVANGGMAAVVCFGLAVVFLLNRSVRRRQVLEIGVFRMLGLVAVLAFSAPSLWEWANALPLLLKGADVVNTGNARYVLTALCMPFPAVSCIIGLVGRFRLQTASGRVAKAGGAVKAGG

SEQ ID NO: 8139 - DNA, 939 bp, Neisseria gonorrhoeae; identical to SEQ ID NO: 3981

SEQ ID NO: 8140 - protein, 313 aa, Neisseria gonorrhoeae; identical to SEQ ID NO: 3982

SEQ ID NO: 8141 - DNA, 126 bp, Neisseria gonorrhoeae
ttgcctcgccttgccgtactatttgtactgtctgcggcttcgtcgccttgtcctgatttaaatttaatccactatacccgaccacgcaagccgccgaacaaaaaacaagggcctgtcctagataac

SEQ ID NO: 8142 - protein, 42 aa, Neisseria gonorrhoeae
LPRLAVLFVLSAASSPCPDLNLIHYTRPRKPPNKKQGPVLDN

SEQ ID NO: 8143 - DNA, 114 bp, Neisseria gonorrhoeae
gtggtcgggtatagtggattaaatttaaatcaggacaaggcgacgaagccgcagacagtacaaatagtacggcaaggcgaggcaacgccgtactggtttaaatttaatccacta

SEQ ID NO: 8144 - protein, 38 aa, Neisseria gonorrhoeae
VVGYSGLNLNQDKATKPQTVQIVRQGEATPYWFKFNPL

SEQ ID NO: 8145 - DNA, 1728 bp, Neisseria gonorrhoeae
gtgaaaccgctgcgcagactgacaaacctccttgccgcctgcgccgtagcggcggtcgcactcatacagcccgccctcgcggcggacttggcgcaagacccgttcattaccgataacacccaacggcagcactacgaacccggcggcaaataccacctcttcggcgacccgcgcggcagcgtttccgaccgcaccggcaaaatcaacgtcatccaagactatacccaccagatgggcaacctgctcatccaacaggcggcaatccaaggcaatcttggttacaccgtccgcttttccggacacggacacgaagaacacgcccccttcgacaaccacgccgccgacagcgcaagcgaagaaaaaggcaacgttgacgacggctttaccgtgtaccggctcaactgggaaggacacgaacatcatcccgccgatgcctacgacggcccgaagggcggcaattaccccaaacctacgggcgcacgagacgaatacacctatcacgtcaacggcacagcccgcagtatcaaactcaatccgaccgacacccgcagcatccggcaacgcatattcgacaactacaacaacctcggcagcaatttctccgaccgcgccgatgaagccaacagaaaaatgttcgagcacaatgccaagctcgaccgctggggcaacagcatggagtttgtcaacggcgtcgccgccggcgcgctcaacccctttatcagcgcgggcgaagccttgggcataggcgacatactgtacggaacgcgctatgccatagacaaagccgcgatgcgcaacatcgcccccttacccgccgagggcaaattcgccgccatcggcggcttgggcagcgcggcgggctttgaaaaaaatacgcgcgaagccgttgaccggtggatacaggaaaaccccaatgccgccgaaaccgtcgaagccctggtcaacgtcctgccgtttgccaaagtcaaaaacctgacaaaggcggcaaaaccggggaaggctgcggttagtggggatttttctaaatcctacacctgctccttccacggcagcaccttggtcaaaacggcagacggctacaaagccattgcccatattcaagccggagaccgcgtcctttccaaggacgaggcaagcggagaaacgggatacaaacccgttaccgcccgatacggcaatccgtatcaagaaaccgtttacattgaagtttcagacggcatcggcaacagccaaaccctgatttccaaccgcatccacccgttttattcggacggcaaatggattaaggcggaagatttaaaagcgggaagccggctgttatccgaaagcggcaaaacccaaaccgtccgcaacatcgttgtcaaaccaaaaccgctcaaagcctacaatctgaccgttgccgattggcatacctacttcgtcaagggtaatcaggcggaaacggaaggggtttgggttcataatgattgtccgcctaaaccaaaaccaaccaatcatgcccaacaaagaaaagaagaagctaaaaacgattctcatcgaagtgtgggagattccaatcgtgtcgttcgcgaaggaaagcaatatttagattccgacacaggaaaccatgtttatgtaaaaggagataaagtggttattctaactcctgatggaagacaggtaactcaatttaagaactcgaaagccaatacgtcaaaaagggtaaaaaatgggaaatggacaccaaaa

SEQ ID NO: 8146 - protein, 576 aa, Neisseria gonorrhoeae
VKPLRRLTNLLAACAVAAVALIQPALAADLAQDPFITDNTQRQHYEPGGKYHLFGDPRGSVSDRTGKINVIQDYTHQMGNLLIQQAAIQGNLGYTVRFSGHGHEEHAPFDNHAADSASEEKGNVDDGFTVYRLNWEGHEHHPADAYDGPKGGNYPKPTGARDEYTYHVNGTARSIKLNPTDTRSIRQRIFDNYNNLGSNFSDRADEANRKMFEHNAKLDRWGNSMEFVNGVAAGALNPFISAGEALGIGDILYGTRYAIDKAAMRNIAPLPAEGKFAAIGGLGSAAGFEKNTREAVDRWIQENPNAAETVEALVNVLPFAKVKNLTKAAKPGKAAVSGDFSKSYTCSFHGSTLVKTADGYKAIAHIQAGDRVLSKDEASGETGYKPVTARYGNPYQETVYIEVSDGIGNSQTLISNRIHPFYSDGKWIKAEDLKAGSRLLSESGKTQTVRNIVVKPKPLKAYNLTVADWHTYFVKGNQAETEGVWVHNDCPPKPKPTNHAQQRKEEAKNDSHRSVGDSNRVVREGKQYLDSDTGNHVYVKGDKVVILTPDGRQVTQFKNSKANTSKRVKNGKWTPK

SEQ ID NO: 8147 - DNA, 327 bp, Neisseria gonorrhoeae
atgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagtattgtttatacggattgttatcgtagctatgatgtattagatgtgagcgaatttagccattttagcttcgctgaaacttcgttttcgtatcaatcacagcacacattttgccgaacgacaaaaccatat

SEQ ID NO: 8148 - protein, 109 aa, Neisseria gonorrhoeae
MFDGEVEADESYFGGQRKGKRGRGAAGKVAVFGLLKRNGKVYTVTVPNTQTATLFPIIREQVKPDSIVYTDCYRSYDVLDVSEFSHFSFAETSFSYQSQHTFCRTTKPY

SEQ ID NO: 8149 - DNA, 279 bp, Neisseria gonorrhoeae
atgggaaatggacaccaaaataatcaatcttccttagaaaaaagaattttttatctggagcattcggggcagtatctgatgatttgcgccctatcggattactcccaaaataaacatactgtcgttatggcgaatttcctctatccaaatgaaaaaatggattggagaaatttagatgatttgttcaatgagttggttttagaggaattacagtcttcatttatggattggtatccaactattgaaaaggcaattagccatcatttagaagacttttcg

SEQ ID NO: 8150 - protein, 93 aa, Neisseria gonorrhoeae
MGNGHQNNQSSLEKRIFYLEHSGQYLMICALSDYSQNKHTVVMANFLYPNEKMDWRNLDDLFNELVLEELQSSFMDWYPTIEKAISHHLEDFS

SEQ ID NO: 8151 - DNA, 153 bp, Neisseria gonorrhoeae; identical to SEQ ID NO: 7273

SEQ ID NO: 8152 - protein, 51 aa, Neisseria gonorrhoeae; identical to SEQ ID NO: 7274

SEQ ID NO: 8153 - DNA, 606 bp, Neisseria gonorrhoeae
ttgagttatctctctgatagagaaaattccatacgcgaagccgttgaccggtggatacaggaaaatcccaatgccgccgaaaccgtcgaagccgtcttcaacgttgccgccgccaaagtcgcgaagctggcaaaggcggcgaaaccggggaaagctgcggttagcggggatttttcgattagctataaaaacttttctactgtcaaaccaaaagtaattgccaaaggaacgattaatggaaagacttttagagatgttaatcaaagtgcaaaaattggatcgcctgattcacctacattaatagcccaacgagttaatgcaaaaatccaagccgacggtaaacctcgtccgaatgcaaccgttgctaattcacatgctgaaattggtgttatccagcaggcttataatgcaggtgaaacgaaaggggcatctatgacaatgacagtttcaggaaaagatgtttgcggttattgtaaaggagatattgcagctgctgctcaagcttctggactgaaatcactgactgttaatgcgacagataatgtaacaggaaaaaataaaacttactattggacgcctggtatgaaatcaattaaggagagaaaa

SEQ ID NO: 8154 - protein, 202 aa, Neisseria gonorrhoeae
LSYLSDRENSIREAVDRWIQENPNAAETVEAVFNVAAAKVAKLAKAAKPGKAAVSGDFSISYKNFSTVKPKVIAKGTINGKTFRDVNQSAKIGSPDSPTLIAQRVNAKIQADGKPRPNATVANSHAEIGVIQQAYNAGETKGASMTMTVSGKDVCGYCKGDIAAAAQASGLKSLTVNATDNVTGKNKTYYWTPGMKSIKERK

SEQ ID NO: 8155 - DNA, 414 bp, Neisseria gonorrhoeae
atgaaaacatcaacaattgtttttggtggattttttattacagataatggagaacgaatccaaatccctattttagaaaatcctaacattaaagaaataaataactttttttctgtatcaaattttgaaaaaaaagccggagtccttgttttcagaattattcctgagcctgaatttggcaatactgaattaactatctattttgaaaaaggatattatttaccaataattcaaacaattttagaagatggagatattgaagtaaaaaatcttaaaacagaaaattatagtggaaatacaatggaaattttgggagacgtctaccctattgagcatatctctaaaaatatttctataattcaagatataatttctgaatttattatgaaaaataaaccaatcacaataatgatt

SEQ ID NO: 8156 - protein, 138 aa, Neisseria gonorrhoeae
MKTSTIVFGGFFITDNGERIQIPILENPNIKEINNFFSVSNFEKKAGVLVFRIIPEPEFGNTELTIYFEKGYYLPIIQTILEDGDIEVKNLKTENYSGNTMEILGDVYPIEHISKNISIIQDIISEFIMKNKPITIMI

SEQ ID NO: 8157 - DNA, 1470 bp, Neisseria gonorrhoeae; identical to SEQ ID NO: 7279

SEQ ID NO: 8158 - protein, 490 aa, Neisseria gonorrhoeae; identical to SEQ ID NO: 7280

SEQ ID NO: 8159 - DNA, 90 bp, Neisseria gonorrhoeae
ttgaaaagttcaacaatcaaaaggtcgcctgaaatcgtgtttaattttcagacgacctatttccttcatttgaaacaggatattgaaaac

SEQ ID NO: 8160 - protein, 30 aa, Neisseria gonorrhoeae
LKSSTIKRSPEIVFNFQTTYFLHLKQDIEN

SEQ ID NO: 8161 - DNA, 273 bp, Neisseria gonorrhoeae; identical to SEQ ID NO: 7297

SEQ ID NO: 8162 - protein, 91 aa, Neisseria gonorrhoeae; identical to SEQ ID NO: 7298

SEQ ID NO: 8163 - DNA, 180 bp, Neisseria gonorrhoeae
gtggtcgccgacccggatacgggcaatggctttgtagccgtctgccgttttgaccaaggtgctgccgtggaaagggcaggtgtaggatttttgaagaacttagttttcaatatcctgtttcaaatgaaggaaataggtcgtctgaaaattaaacacgatttcaggcgaccttttgattgt

SEQ ID NO: 8164 - protein, 60 aa, Neisseria gonorrhoeae
VVADPDTGNGFVAVCRFDQGAAVERAGVGFLKNLVFNILFQMKEIGRLKIKHDFRRPFDC

SEQ ID NO: 8165 - DNA, 456 bp, Neisseria gonorrhoeae; identical to SEQ ID NO: 4343

SEQ ID NO: 8166 - protein, 152 aa, Neisseria gonorrhoeae; identical to SEQ ID NO: 4344

SEQ ID NO: 8167 - DNA, 522 bp, Neisseria gonorrhoeae; identical to SEQ ID NO: 7479

SEQ ID NO: 8168 - protein, 174 aa, Neisseria gonorrhoeae; identical to SEQ ID NO: 7480

SEQ ID NO: 8169 - DNA, 345 bp, Neisseria gonorrhoeae; identical to SEQ ID NO: 7303

SEQ ID NO: 8170 - protein, 115 aa, Neisseria gonorrhoeae; identical to SEQ ID NO: 7304

SEQ ID NO: 8171 - DNA, 192 bp, Neisseria gonorrhoeae
ttgggatatagaaaaataaaagaaagaacgagaaatgatgctgctatttttaaaaaaggaaagagttatatatcacgcgatgtagattcacataatggaggggcttggaaagaagcatcttcacccaaaaatctgaacagaaaagaaacaagaaacggtacatttgataaaaacctaaatcgtattggagat

SEQ ID NO: 8172 - protein, 64 aa, Neisseria gonorrhoeae
LGYRKIKERTRNDAAIFKKGKSYISRDVDSHNGGAWKEASSPKNLNRKETRNGTFDKNLNRIGD

SEQ ID NO: 8173 - DNA, 651 bp, Neisseria gonorrhoeae
ttgagcagcggcagtaggattagaaggtgttgcttgcagcatttgcgctttttttgggattcctcagtcggcatatttgcgcagttcggcggaattatgttgggcgatgatgcctgcgccgaaggaatggcgttcgttgagtttccacgcggcgacaggttcgacggcgatgctggtcagaccgagtttgttgatgttgtggcgcaacacggaatctttttcgtattcggtggcagagccgaaggggacgtacacgcccaagcccacggtcagattgtcgttgactttgtatgcgccgtaaatgtggggtgcgaccgtggttttggtgattttgccgtttttagaaccttggacgggaagcccggtaaagtcggtggcggaatctgcttcataatgaatgctgggcagcacgatgttggcgttgacggaaatctggctgctgtcgagtttggtcaggccggcgggattgtagaagatggtcgacgcgtcggcggcatttgccgtgctttgcgcgttgaccgactgtgtgccgaagtggtagccggatgcgtggacagatgcggcggcaaaggcagtgccgagcagcaggacggttttttcagtgtgaaaggggtcatttcggtttccgtaaaaaggcggacggtggacaaa

SEQ ID NO: 8174 - protein, 217 aa, Neisseria gonorrhoeae
LSSGSRIRRCCLQHLRFFWDSSVGIFAQFGGIMLGDDACAEGMAFVEFPRGDRFDGDAGQTEFVDVVAQHGIFFVFGGRAEGDVHAQAHGQIVVDFVCAVNVGCDRGFGDFAVFRTLDGKPGKVGGGICFIMNAGQHDVGVDGNLAAVEFGQAGGIVEDGRRVGGICRALRVDRLCAEVVAGCVDRCGGKGSAEQQDGFFSVKGVISVSVKRRTVDK

SEQ ID NO: 8175 - DNA, 396 bp, Neisseria gonorrhoeae
atgtgcgagttcaaggattttagaagaaacatcccttgttttgaagagtatgacgaaaattcatttattggcaaatggtatgatgacggagtgtgggatgatgaagaatattggaaattggagaatgctttaatcgaggttagaaaaaaatatccttatccgatggatataccaagggacatcgtgattggaatcggtaccattattgattttttaatggttcaaaattggaaactttttgaaattaaagcttctccttggttgcctaaaagtgtcaaaattaatgagcgttatgaaaggttcagagtaatgctccgttatatttttactgatctagatgcagaggactggaaatttttttactttccaatacaacatagtaaaggtagattgaga

SEQ ID NO: 8176 - protein, 132 aa, Neisseria gonorrhoeae
MCEFKDFRRNIPCFEEYDENSFIGKWYDDGVWDDEEYWKLENALIEVRKKYPYPMDIPRDIVIGIGTIIDFLMVQNWKLFEIKASPWLPKSVKINERYERFRVMLRYIFTDLDAEDWKFFYFPIQHSKGRLR

SEQ ID NO: 8177 - DNA, 804 bp, Neisseria gonorrhoeae; identical to SEQ ID NO: 7311

SEQ ID NO: 8178 - protein, 268 aa, Neisseria gonorrhoeae; identical to SEQ ID NO: 7312

SEQ ID NO: 8179 - DNA, 375 bp, Neisseria gonorrhoeae
atgtgtgagttcaaggatattataagaaacgttccttattttgaggggtatgacgaaaattcatttattggcaaatggtatgatgacggggtgtgggatgatgaagaatattggaagttggagaatgatttaatcgaggttaggagaaaatatccttatccgatggatataccaagggatatcgtgattggaatcggtaccattattgagtttttaatggttccaaattggaaactttttgaaattaaagcttccccttggttacctgatagcgtgggaattaacgaacgttatgaaaggcttaaaacaatgctccgttatatttttaccgagaaagacatagtcaacgtgcaatttgattattacaacaaaaaa

SEQ ID NO: 8180 - protein, 125 aa, Neisseria gonorrhoeae
MCEFKDIIRNVPYFEGYDENSFIGKWYDDGVWDDEEYWKLENDLIEVRRKYPYPMDIPRDIVIGIGTIIEFLMVPNWKLFEIKASPWLPDSVGINERYERLKTMLRYIFTEKDIVNVQFDYYNKK

SEQ ID NO: 8181 - DNA, 135 bp, Neisseria gonorrhoeae
ttgaatatgggcgatggctttgtagccgtctgccgttctgaccaaggtgctgccgtggaaagagcaggtgtaggatttttgaagaacttagttcccaatatcctgtttaaaataaggggaaggtcgcctgaaaat

SEQ ID NO: 8182 - protein, 45 aa, Neisseria gonorrhoeae
LNMGDGFVAVCRSDQGAAVERAGVGFLKNLVPNILFKIRGRSPEN

SEQ ID NO: 8183 - DNA, 420 bp, Neisseria gonorrhoeae; identical to SEQ ID NO: 217

SEQ ID NO: 8184 - protein, 140 aa, Neisseria gonorrhoeae; identical to SEQ ID NO: 218

SEQ ID NO: 8185 - DNA, 207 bp, Neisseria gonorrhoeae
ttgaataggattcaaaataatggtcaagttaagtgcgctaattgcggtattgaaacaattccagccaaacaatctataaaaaatatttctcctacttcaaatgaaagacaagtagatcatgtcatccctaaatctaagggtggtcaaggtacacctaaaaacgggcaggtattatgcagaggctgcaacattaagaagagtaacaaa

SEQ ID NO: 8186 - protein, 69 aa, Neisseria gonorrhoeae
LNRIQNNGQVKCANCGIETIPAKQSIKNISPTSNERQVDHVIPKSKGGQGTPKNGQVLCRGCNIKKSNK

SEQ ID NO: 8187 - DNA, 417 bp, Neisseria gonorrhoeae; identical to SEQ ID NO: 27

SEQ ID NO: 8188 - protein, 139 aa, Neisseria gonorrhoeae; identical to SEQ ID NO: 28

SEQ ID NO: 8189 - DNA, 123 bp, Neisseria gonorrhoeae
ttgccgtactatctgtactgtctgcggcttcgtcgccttgtcctgatttttgttaatccgctatattgtccattcggcagggaaagcctgaagaagaattttcccgcaagatggccggctgcc

SEQ ID NO: 8190 - protein, 41 aa, Neisseria gonorrhoeae
LPYYLYCLRLRRLVLIFVNPLYCPFGRESLKKNFPARWPAA

SEQ ID NO: 8191 - DNA, 114 bp, Neisseria gonorrhoeae
gtggaaggagcaggtgtaggatttttgaaaaacttaattcccaatatcctgtttcaaatgaaggaaataggtcgtctgaaaattaaacacggtttcagacgaccttttaatcgt

SEQ ID NO: 8192 - protein, 38 aa, Neisseria gonorrhoeae
VEGAGVGFLKNLIPNILFQMKEIGRLKIKHGFRRPFNR

SEQ ID NO: 8193 - DNA, 156 bp, Neisseria gonorrhoeae
ttgacggaaatgccgtctgaaaccctgttgtcggtttcagacggcattttgaccaatacggtacgcaggcgcaaaacagccggcttttcctgtgtttcctatgctgatgtttcaacacacaggacggcacataaagcgtcgccctatgtgccgtcc

SEQ ID NO: 8194 - protein, 52 aa, Neisseria gonorrhoeae
LTEMPSETLLSVSDGILTNTVRRRKTAGFSCVSYADVSTHRTAHKASPYVPS

SEQ ID NO: 8195 - DNA, 270 bp, Neisseria gonorrhoeae
atgatgagtgtaaaagaattattcaaagtcatcttagatgaaaataaagattttcctattagaacgattcatcgtaccccgatggggatacttcccaaacctgttgctttaagtattgttcaatatgaaaatgacccgggattttatttgttttatttggatgagaccggtcaggaacaaacggatacttatcatgacacattagattcggcatttgaacaggctgaatttgaatttggaatcagcaaagaggaatggatgcaaagtcct

SEQ ID NO: 8196 - protein, 90 aa, Neisseria gonorrhoeae
MMSVKELFKVILDENKDFPIRTIHRTPMGILPKPVALSIVQYENDPGFYLFYLDETGQEQTDTYHDTLDSAFEQAEFEFGISKEEWMQSP

SEQ ID NO: 8197 - DNA, 417 bp, Neisseria gonorrhoeae
gtgcttcatcaccttagggaatcgttccctttgagccggggcggggcaacgccgtaccggtttttgttaatccgccatatcgtcgcaagatgcggtttgttgtttgcaacccttaaaggaaaaaccatgaaaaaaatgtttgtattgttctgtatgctgttctcctgcgccttctcccttgcggcggtaaacatcaatgcggcttcgcagcaggagctggaggcgctgccgggcataggcccggcgaaggccattgcggaataccgcgcgcaaaacggcgcgttcaagtctgtggacgatttgatcaaggtgaagggcatcggtccggcggtgctggcgaagctgaaagaccaggcttccgtcggcgcgcccgcaccaaaaggccccgccaaaccggtgctgcctgcggttaaaaaa

SEQ ID NO: 8198 - protein, 139 aa, Neisseria gonorrhoeae
VLHHLRESFPLSRGGATPYRFLLIRHIVARCGLLFATLKGKTMKKMFVLFCMLFSCAFSLAAVNINAASQQELEALPGIGPAKAIAEYRAQNGAFKSVDDLIKVKGIGPAVLAKLKDQASVGAPAPKGPAKPVLPAVKK

SEQ ID NO: 8199 - DNA, 1044 bp, Neisseria gonorrhoeae
ttgaacggaggacaaaaaatgattacaccgcaacaggctatcgaacgattaatcagcaataacgagttgttttacgatgaaatgaccgacttgatgcgccaaatgatgagcggaaaagtgccgcccgaacaaattgcggcgattttgaccggcttgcgtatcaaggttgaaaccgtttccgaaatcaccgccgccgccgccgtgatgtgcgagtttgcgtcaaaagtgccgctggaggatgcggacgggctggtcgatatcgtcggtacgggcggggatggcgcgaaaaccttcaatatttcgacgacttcgatgtttgttgctgcagcggcaggcgcaaaggttgccaaacacggaggccggtcggtctcttcctccagcggtgcggctgacgtgatggagcaaatgggcgcaaacctcaacctgactcccgaacagattgcccaaagtatcaggcagaccggtatagggtttatgttcgcacccaatcaccacagtgccatgcgccatgtcgccccggtgcgccgttcgctcggtttccgaagcattttcaacatattgggtccgttaaccaatcctgcgggcgcgccgaaccagcttttgggcgtgttccacaccgatttgtgcggcattttgtcgcgggtcttgcaacaactcggctcaaaacacgttttggtcgtttgcggggagggcggtttggatgaaattacactgacgggcaaaacgcgcgttgccgaactcaaagacggaaaaatcagcgaatacgacatccgcccagaagatttcggtatcgaaacccgccgcaatttggatgaaatcaaagttgccaatactcaggaatctttgttgaaaatgaacgaggtactggacgggaaagaaggggcggcgcgcgatatcgtattgcttaataccgccgccgccttatatgccggaaatatcgctgcttcgctttcagacggcatatctgccgcacgggaaggcatcgattcaggtagggcgaaggcgaaaaaagaggagtttgtcggttttacacggcaattcgcc

SEQ ID NO: 8200 - protein, 348 aa, Neisseria gonorrhoeae
LNGGQKMITPQQAIERLISNNELFYDEMTDLMRQMMSGKVPPEQIAAILTGLRIKVETVSEITAAAAVMCEFASKVPLEDADGLVDIVGTGGDGAKTFNISTTSMFVAAAAGAKVAKHGGRSVSSSSGAADVMEQMGANLNLTPEQIAQSIRQTGIGFMFAPNHHSAMRHVAPVRRSLGFRSIFNILGPLTNPAGAPNQLLGVFHTDLCGILSRVLQQLGSKHVLVVCGEGGLDEITLTGKTRVAELKDGKISEYDIRPEDFGIETRRNLDEIKVANTQESLLKMNEVLDGKEGAARDIVLLNTAAALYAGNIAASLSDGISAAREGIDSGRAKAKKEEFVGFTRQFA

SEQ ID NO: 8201 - DNA, 195 bp, Neisseria gonorrhoeae
atgaataccgtccccaaaagcaggattcccgtcaaaccgctgcccgaaaaaaccacagccgaagccaaagtcgaaaaatggcggcagctcggtgcggaccacggtttgtcgggcgaatgggcagttgccgccagattgggcgaaaacggttttactgaagaacagatggaaaatatcgccaacctgttcggcaga

SEQ ID NO: 8202 - protein, 65 aa, Neisseria gonorrhoeae
MNTVPKSRIPVKPLPEKTTAEAKVEKWRQLGADHGLSGEWAVAARLGENGFTEEQMENIANLFGR

SEQ ID NO: 8203 - DNA, 150 bp, Neisseria gonorrhoeae
atggatgcaaagtccttagacggcaaaatcaagatgccgctttatttttcagacggcatttccgtcaataaaaaagtcggtattggagcccaaaacagcctacgtcttgccgggatagggatgaaatctttaagaaaaaatgattatagt

SEQ ID NO: 8204 - protein, 50 aa, Neisseria gonorrhoeae
MDAKSLDGKIKMPLYFSDGISVNKKVGIGAQNSLRLAGIGMKSLRKNDYS

SEQ ID NO: 8205 - DNA, 543 bp, Neisseria gonorrhoeae
atgattatagttgaacatttagaacattatttgggtgaaatcgaaagcggtataaaatgcttggatcgacgttatcatctcagcgtttccgtcttcccatcacaaccatataaaggggtaactactttttctactttaggcttgaatcgatatgacttgaactataagagtaggtttgaattaatttttacctgttctgaagaatggaataaagaaaatattgcagcttttctatcaggagtggctgaatatttgattgacaatagacaacctattttaagaggtgaaattattcaattacccagggtaattatcgaaggtagcaaaatggatgcactgtatgtttccgccccattttatttcgatgatgattttcaggtctgttatggcgaacactacaatatcgttttccctttgcttgtccccttgtataaacaggaagcagaattggtggaaaagaaaggttggaatgcttttgagcagttcttgctgaataatgaagttgacaacctttcggatatgaagcggaaaccgtttgcttgg

SEQ ID NO: 8206 - protein, 181 aa, Neisseria gonorrhoeae
MIIVEHLEHYLGEIESGIKCLDRRYHLSVSVFPSQPYKGVTTFSTLGLNRYDLNYKSRFELIFTCSEEWNKENIAAFLSGVAEYLIDNRQPILRGEIIQLPRVIIEGSKMDALYVSAPFYFDDDFQVCYGEHYNIVFPLLVPLYKQEAELVEKKGWNAFEQFLLNNEVDNLSDMKRKPFAW

SEQ ID NO: 8207 - DNA, 1014 bp, Neisseria gonorrhoeae
atgtatcggaaactcattgcgctgccgtttgccctgctgcttgcagcgtgcggcagggaagaaccgcccaaggcgttggaatgcgccaaccccgccgtgttgcaggacatacgcggcagtattcaggaaacgctcacgcaggaagcgcgttctttcgcgcgcgaagacggcaggcagtttgtcgatgccgacaaaattatcgccgccgcctacggtttggcgttttctttggaacacgcttcggaaacgcaggaaggcgggcgcacgttctgtatcgccgatttgaacattaccgtgccgtctgaaacgcttgccgatgccgaggcaaacagccccctgctgtatggggaaacgtctttggcagacatcgtgcagcagaagacgggcggcaatgtcgagtttaaagacggcgtattgacggcagccgtccgcttcctgcccgccaaagacgctcggacggcatttatcgacaacacggtcggtatggcgacgcaaacgctgtctgccgcgttgctgccttacggcgtgaagagcatcgtgatgatagacggcaaggcggtgacaaaagaagacgcggtcagggttttgagcggcaaagcccgtgaagaagaaccgtccaaacccacccccgaagacattttggaacacaatgccgccggcggcgatgcgggcgtaccccaagccgcagaaggcgcacccgaacccgaaatcctgcatcccgacgacgtcgagcgtgccgataccgttaccgtatcacggggcgaagtggaagaggcgcgcgtacaaaaccaacgtgcggaatccgaaattaccaaactttggggaggactcgataccgacgtgcaaaaagagttggtcggcgaacagcgcaagtgggcgcaggaaaaaatcagcaactgccgacaagccgccgcgcaggcagaccggcaggaatacgccgaatacctcaagctccaatgcgacacgcggatgacgcgcgaacggatacagtatcttcgcggctattccatcgat

SEQ ID NO: 8208 - protein, 338 aa, Neisseria gonorrhoeae
MYRKLIALPFALLLAACGREEPPKALECANPAVLQDIRGSIQETLTQEARSFAREDGRQFVDADKIIAAAYGLAFSLEHASETQEGGRTFCIADLNITVPSETLADAEANSPLLYGETSLADIVQQKTGGNVEFKDGVLTAAVRFLPAKDARTAFIDNTVGMATQTLSAALLPYGVKSIVMIDGKAVTKEDAVRVLSGKAREEEPSKPTPEDILEHNAAGGDAGVPQAAEGAPEPEILHPDDVERADTVTVSRGEVEEARVQNQRAESEITKLWGGLDTDVQKELVGEQRKWAQEKISNCRQAAAQADRQEYAEYLKLQCDTRMTRERIQYLRGYSID

SEQ ID NO: 8209 - DNA, 96 bp, Neisseria gonorrhoeae
ttggtaagggctttcttaaatttgattaaaggtcgtctgaaattaagcttgtttttcagatggtctttccttcatttgaagcaggatattgagaac

SEQ ID NO: 8210 - protein, 32 aa, Neisseria gonorrhoeae
LVRAFLNLIKGRLKLSLFFRWSFLHLKQDIEN

SEQ ID NO: 8211 - DNA, 261 bp, Neisseria gonorrhoeae
ttgccctgccggataaagcaggtctgcctccgtactgtctatcctcacatttactttcctgccatcggcttttatctccccggttttaccgtttttgccaacttcgcggctttggcggtggcaatgttgaaggcggcttcgacggtttcggcggcattggggttgacccgtactcatccgcaaacggcaacacgacggacggtgtttgcttttcagccgtctgccgttttgaccaaggtgctgccgtggaaggagcaggtg

SEQ ID NO: 8212 - protein, 87 aa, Neisseria gonorrhoeae
LPCRIKQVCLRTVYPHIYFPAIGFYLPGFTVFANFAALAVAMLKAASTVSAALGLTRTHPQTATRRTVFAFQPSAVLTKVLPWKEQV

SEQ ID NO: 8213 - DNA, 399 bp, Neisseria gonorrhoeae
gtgaagattaaaccattacaattttctaacaataatcacagattttatgtggacaaaatttgtgttaccgaacaagatgtgaacattttggcatccgaccgaaattatgaattaaatattgaaatatttattgacaatataattcattttcaaataacggatgaatcttataaagtaaaattttcagaatatttattcgaaaataaaacagaaaataattcggatgggaatcctactgcaaattattttttcgagataatagatgacagttatatggactggttgaaagaagaaagttttggtttttttgaaaagaaatattataaggcttatattttcttttttagcgattctgtaatagaagttatcagctcgacagaacctgtattttattcaaaa

SEQ ID NO: 8214 - protein, 133 aa, Neisseria gonorrhoeae
VKIKPLQFSNNNHRFYVDKICVTEQDVNILASDRNYELNIEIFIDNIIHFQITDESYKVKFSEYLFENKTENNSDGNPTANYFFEIIDDSYMDWLKEESFGFFEKKYYKAYIFFFSDSVIEVISSTEPVFYSK

SEQ ID NO: 8215 - DNA, 1302 bp, Neisseria gonorrhoeae
ttgacaagccttaactattcccctaatatcttcgcgcttgcgtccccttcgggcggatataaagaaaaacattttaggaggtcaaacgatatggaatgggcgtttaacagttattacaccttgattgccgccactttggttttgttggtcggcaaggttttggttaagaaaatcaaaatcttgcgtgattttaacatccccgaacccgtggcgggcgggctgattgccgcgattatcctgtttgcgctgcacgaggcgtacggcgtgagcttcaaatttgagaaaccgctgcaaaatgcgtttatgctgattttcttcacgtccatcggcttgagcgcggatttttcccgtttgaaggcgggcggtttgccgctggtggtttttaccgcgattgtgggcggatttatcttggtgcaaaactttgtcggggtcggactggctacggctttgggtttggacccgctcatcggtctgattaccggttcggtgtcgctgacgggcggacacggcacgtcaggtgcgtggggacctaattttgaaacgcaatacggcttggtcggcgcaaccggtttgggtattgcttcggttactttcgggctggtgttcggcggcctgatcggagggccggttgcgcgccgcctgatcaacaaaatgggccgcaaaccggttgaaaacacaaaacaggatcaggacgacaacgcggacgacgtgttcgagcaggcaaaacgcacccgcctgattacggcggaatctgccgttgaaacgcttgccatgtttgccgcgtgtctggcgtttgccgagattatggacggtttcgacaaagaatacctgttcgacctgcccaaattcgtgtggtgtctgtttggcggcgtggttatccgcaacatccttaccgccgcattcaaggtcaatatgttcgaccgtgccatcgatgtgttcggcaatgcttcgctttcgcttttcttggcaatggcgttgctgaatttgaaactgtgggagctgaccggtttggcggggtctgtaaccgtgattcttgcagtacaaaccgcagtgatggttttgtacgcgacttttgttacctatgtctttatggggcgcgactatgatgccgcagtattggctgccggccactgcggtttcggtttgggcgcaacgccgacggcggtggcaaatatgcagtccgtcacgcatactttcggcgcgtcacataaggcgtttttgattgtgcctatggtcggcgcgttctttgtcgatttgattaatgccgcgattctcaccggttttgtgaatttctttaaaggc

SEQ ID NO: 8216 - protein, 434 aa, Neisseria gonorrhoeae
LTSLNYSPNIFALASPSGGYKEKHFRRSNDMEWAFNSYYTLIAATLVLLVGKVLVKKIKILRDFNIPEPVAGGLIAAIILFALHEAYGVSFKFEKPLQNAFMLIFFTSIGLSADFSRLKAGGLPLVVFTAIVGGFILVQNFVGVGLATALGLDPLIGLITGSVSLTGGHGTSGAWGPNFETQYGLVGATGLGIASVTFGLVFGGLIGGPVARRLINKMGRKPVENTKQDQDDNADDVFEQAKRTRLITAESAVETLAMFAACLAFAEIMDGFDKEYLFDLPKFVWCLFGGVVIRNILTAAFKVNMFDRAIDVFGNASLSLFLAMALLNLKLWELTGLAGSVTVILAVQTAVMVLYATFVTYVFMGRDYDAAVLAAGHCGFGLGATPTAVANMQSVTHTFGASHKAFLIVPMVGAFFVDLINAAILTGFVNFFKG

SEQ ID NO: 8217 - DNA, 105 bp, Neisseria gonorrhoeae; identical to SEQ ID NO: 7361

SEQ ID NO: 8218 - protein, 35 aa, Neisseria gonorrhoeae; identical to SEQ ID NO: 7362

SEQ ID NO: 8219 - DNA, 105 bp, Neisseria gonorrhoeae
ttgcgtgccaacaacttcggcaaaatcaagccggcaagcccctgcatcctgtgccaatcggagaaaatgccgtctgaaagccgaataccgcttcagacggcattc

SEQ ID NO: 8220 - protein, 35 aa, Neisseria gonorrhoeae
LRANNFGKIKPASPCILCQSEKMPSESRIPLQTAF

SEQ ID NO: 8221 - DNA, 162 bp, Neisseria gonorrhoeae
ttgctgccgtactttttcggaaacaaattgggtaaaactaaaaatatccttaacgatttatttttcataggttgtcgccccctccaaattgcgtgccaacaacttcggcaaaatcaagccggcaagcccctgcatcctgtgccaatcggagaaaatgccgtc

SEQ ID NO: 8222 - protein, 54 aa, Neisseria gonorrhoeae
LLPYFFGNKLGKTKNILNDLFFIGCRPLQIACQQLRQNQAGKPLHPVPIGENAV

SEQ ID NO: 8223 - DNA, 279 bp, Neisseria gonorrhoeae
gtgaagcaaatcaaagcgtccgacttcaccgacgaacacttcggactgccgaccattctggacattctgtccgagctggaaaaaccgcagccgcgaacggacagccggccgcaaaccacaacgcaacgagcgtgtcccaaccaattcggcgatggcggatgcgtttgcgaagttgaagcggtaagtccgacagcagggatgtacagcgacagatgcagcggcgggttttgcccccgctttttctgttatttcaaatatgtgtattcccatgatgccgtc

SEQ ID NO: 8224 - protein, 93 aa, Neisseria gonorrhoeae
VKQIKASDFTDEHFGLPTILDILSELEKPQPRTDSRPQTTTQRACPNQFGDGGCVCEVEAVSPTAGMYSDRCSGGFCPRFFCYFKYVYSHDAV

SEQ ID NO: 8225 - DNA, 315 bp, Neisseria gonorrhoeae; identical to SEQ ID NO: 219

SEQ ID NO: 8226 - protein, 105 aa, Neisseria gonorrhoeae; identical to SEQ ID NO: 220

SEQ ID NO: 8227 - DNA, 1131 bp, Neisseria gonorrhoeae
atgtttaaaaaattcaaaccggtactgttgtcattttttgcacttgtatttgccttttggctgggaacaggtattgcctatgagattaatccgcgttggtttttgagcgatacggcaactgaagtacctgaaaatccgaatgcttttgtggcgaaacttgcccgcctgttccgaaatgccgacagggcggttgtcatcgtgaaggaatcgatgaggacggaggaaagccttgccggagctgtggatgacggtccgttgcagtcggagaaggattatctcgcgctcgctatccggctcagtcgtttgaaagaaaaggcgaaatggtttcacgtaacggagcaggaacatggggaagaggtttggctggattactatatcggcgagggcggtttggttgcggtttcgctttcgcaacgctcgccggaagcgtttgttaatgccgaatatctgtatcggaacgatcgtccgttttctgtaaatgtgtacggcggaacggctcacggggaaaattatgaaacgacaggagaatatcgggttgtttggcaaccggacggttcggtatttgatgcggcggggcgcgggaaaatcggggaagatgtttatgagcattgcctcgggtgttatcagatggcccaggtatatttggcgaaataccgggatgtcgcgaatgacgagcagaaggtttgggacttccgcgaagagagcaaccggattgcatcggactcgcgcgattatgtgttttatcagaatatgcgggaattgatgccccgggggatgaaggcgaacagtcttgtggtcggctatgatgcggacggtctgccgcaaaaagtctattggagtttcgacaatggaaaaaaacgccagagtttcgaatattatttgaaaaacggaaatctttttattgcacaatcttcgacggtagcattgaaagcggatggcgtaacggcggatatgcagacctatcatgcgcaacagacgtggtatttggatggcgggcggattatccgcgaagagaaacagggagacagactgcctgattttcctttgaacttggaagatttggaaaaagaggtgagccgttatgcagaggctgcggcgagacgttcgggcggcaggcgcggcctttctcac

SEQ ID NO: 8228 - protein, 377 aa, Neisseria gonorrhoeae
MFKKFKPVLLSFFALVFAFWLGTGIAYEINPRWFLSDTATEVPENPNAFVAKLARLFRNADRAVVIVKESMRTEESLAGAVDDGPLQSEKDYLALAIRLSRLKEKAKWFHVTEQEHGEEVWLDYYIGEGGLVAVSLSQRSPEAFVNAEYLYRNDRPFSVNVYGGTAHGENYETTGEYRVVWQPDGSVFDAAGRGKIGEDVYEHCLGCYQMAQVYLAKYRDVANDEQKVWDFREESNRIASDSRDYVFYQNMRELMPRGMKANSLVVGYDADGLPQKVYWSFDNGKKRQSFEYYLKNGNLFIAQSSTVALKADGVTADMQTYHAQQTWYLDGGRIIREEKQGDRLPDFPLNLEDLEKEVSRYAEAAARRSGGRRGLSH

SEQ ID NO: 8229 - DNA, 855 bp, Neisseria gonorrhoeae; identical to SEQ ID NO: 221

SEQ ID NO: 8230 - protein, 285 aa, Neisseria gonorrhoeae; identical to SEQ ID NO: 222

SEQ ID NO: 8231 - DNA, 648 bp, Neisseria gonorrhoeae; identical to SEQ ID NO: 1283

SEQ ID NO: 8232 - protein, 216 aa, Neisseria gonorrhoeae; identical to SEQ ID NO: 1284

SEQ ID NO: 8233 - DNA, 327 bp, Neisseria gonorrhoeae
atgaatgatagatattacttaaatacaaaaacagaatattggtatcgaatattcttggagacagagatgagtaataatcagccaaacagccaaatttatgaagattattgggcgtttaccaatgcctttacaaattataacgatcaaaaattttgtactgcactcaatatttgtcttgactttattgatgcgaatcaagaccagccatacagcaacgaactatatgaagcattgcagcaaaacattgcccaagattccgttatggcttcgcagagaacaagcaaggccatgaatttggcctcggttcgtaagctattaatcaatttg

SEQ ID NO: 8234 - protein, 109 aa, Neisseria gonorrhoeae
MNDRYYLNTKTEYWYRIFLETEMSNNQPNSQIYEDYWAFTNAFTNYNDQKFCTALNICLDFIDANQDQPYSNELYEALQQNIAQDSVMASQRTSKAMNLASVRKLLINL

SEQ ID NO: 8235 - DNA, 147 bp, Neisseria gonorrhoeae
atgccgtctgaaaccggttttcagacggcattggagagtcaaacgctttttgcaatgccgtatatgccgaacccggttcgctacaaattgaaaaccacaatccaaaaaacggaaatacacattatcaaacaaacaaatatagtggat

SEQ ID NO: 8236 - protein, 49 aa, Neisseria gonorrhoeae
MPSETGFQTALESQTLFAMPYMPNPVRYKLKTTIQKTEIHIIKQTNIVD

SEQ ID NO: 8237 - DNA, 1005 bp, Neisseria gonorrhoeae
atgaataagaaatatccgaaaattaactatatcggtaataaagagaaaatagcttcctggatttgtgaccagcttccgtctgatgtagatacagttgcagatgtatttagtggaggctgttcctttgcctacgaagccaaaaaacgcggctatcgtgtgattactaacgatattttggcaattaattaccaaattgctttagcattaatagaaaacaaccatgaaacattaaatgacgatgatgtcgcaatgattttttcaggcagcccgcatgccggttttatgagtcagcgttattccgaaaaattctattttcacgatgaatgccaacaacttgatttgtaccgtaaaaatatagggaagctgaataaccagtataaacgtgctttggcgtttactttaatgcgtcgcgccatgatacgtaaaatgccctattcacgattcacaattccttgggaaaaagttaaacaactgcgtgatgaagaatacagttatgctaaatatggccgtcgacgcgcctaccacaatgaaagttttcaaagtcattttctgcaaaatttggatgactataaccaagctgttttcaataatggctggcggcatcacgcctttaatcaagatatatttgatttattacctaatatacaagctgatgccgtctatttagacccaccttacacaggcacgatgaacaattattttggcttttacggattattggacagttacattacatcatccatacccaaaccatttgccaatcatttcatggataaaaagcaggctgtcgaattatttaaaagggtaatcaatcatttgaaaccatttaaatattggctgttaagctacaacaatgcttcatatccaaaccgagatgaattagaagaaatgttaggtaaaaatgggcgaaatgtacaaatcttggaaacgcctcacgtttataaggttacaggaaaagaaaagaagcaaagccataaggaaattctgtttttagtagaaaataca

SEQ ID NO: 8238 - protein, 335 aa, Neisseria gonorrhoeae
MNKKYPKINYIGNKEKIASWICDQLPSDVDTVADVFSGGCSFAYEAKKRGYRVITNDILAINYQIALALIENNHETLNDDDVAMIFSGSPHAGFMSQRYSEKFYFHDECQQLDLYRKNIGKLNNQYKRALAFTLMRRAMIRKMPYSRFTIPWEKVKQLRDEEYSYAKYGRRRAYHNESFQSHFLQNLDDYNQAVFNNGWRHHAFNQDIFDLLPNIQADAVYLDPPYTGTMNNYFGFYGLLDSYITSSIPKPFANHFMDKKQAVELFKRVINHLKPFKYWLLSYNNASYPNRDELEEMLGKNGRNVQILETPHVYKVTGKEKKQSHKEILFLVENT

SEQ ID NO: 8239 - DNA, 1662 bp, Neisseria gonorrhoeae
atgaaagtgaaggaatatatcagtatttttattttccgttttgatattttatttttttccgagcggtttttatacgccaacagaaaagaaaatgatgaactgtttgttggatttgtattgattaatcagtatattttttataccgaggtatttttccttatcggtatcccttcttttatgaggatgcctgccgctcatataaagaacgggaaaatacgatgggaaaatacggtacagccctcgccgtcgcacaatatgtcaacttatagcggattaacaaaaatcaggacaaggcggcgagccgcagacagtacggatagtacggaaccgattcgcttggtgcttcagcaccttagggaatcgttctctttgagccggggcggggcaacgccgtaccggtttttgttaatccactatatttgtttgtttgataatgtgtatttccgttttttggattgtggttttcaatttgtagcgaaccgggttcggcatatacggcattgcaaaaagcgtttgactctccaatgccgtctgaaaaccggtttcagacggcatttgcgttcagtgagaaaggccgcgcctgccgcccgaacgtctcgccgcagcctctgcataacggctcacctctttttccaaatcttccaagttcaaaggaaaatcaggcagtctgtctccctgtttctcttcgcggataatccgcccgccatccaaataccacgtctgttgcgcatgataggtctgcatatccgccgttacgccatccgctttcaatgctaccgtcgaagattgtgcaataaaaagatttccgtttttcaaataatattcgaaactctggcgtttttttccattgtcgaaactccaatagactttttgcggcagaccgtccgcatcatagccgaccacaagactgttcgccttcatcccccggggcatcaattcccgcatattctgataaaacacataatcgcgcgagtccgatgcaatccggttgctctcttcgcggaagtcccaaaccttctgctcgtcattcgcgacatcccggtatttcgccaaatatacctgggccatctgataacacccgaggcaatgctcataaacatcttccccgattttcccgcgccccgccgcatcaaataccgaaccgtccggttgccaaacaacccgatattctcctgtcgtttcataattttccccgtgagccgttccgccgtacacatttacagaaaacggacgatcgttccgatacagatattcggcattaacaaacgcttccggcgagcgttgcgaaagcgaaaccgcaaccaaaccgccctcgccgatatagtaatccagccaaacctcttccccatgttcctgctccgttacgtgaaaccatttcgccttttctttcaaacgactgagccggatagcgagcgcgagataatccttctccgactgcaacggaccgtcatccacagctccggcaaggctttcctccgtcctcatcgattccttcacgatgacaaccgccctgtcggcatttcggaacaggcgggcaagtttcgccacaaaagcattcggattttcaggtacttcagttgccgtatcgctcaaaaaccaacgcggattaatctcataggcaatacctgttcccagccaaaaggcaaatacaagtgcaaaaaa

SEQ ID NO: 8240 - protein, 554 aa, Neisseria gonorrhoeae
MKVKEYISIFIFRFDILFFSERFLYANRKENDELFVGFVLINQYIFYTEVFFLIGIPSFMRMPAAHIKNGKIRWENTVQPSPSHNMSTYSGLTKIRTRRRAADSTDSTEPIRLVLQHLRESFSLSRGGATPYRFLLIHYICLFDNVYFRFLDCGFQFVANRVRHIRHCKKRLTLQCRLKTGFRRHLRSVRKAAPAARTSRRSLCITAHLFFQIFQVQRKIRQSVSLFLFADNPPAIQIPRLLRMIGLHIRRYAIRFQCYRRRLCNKKISVFQIIFETLAFFSIVETPIDFLRQTVRIIADHKTVRLHPPGHQFPHILIKHIIARVRCNPVALFAEVPNLLLVIRDIPVFRQIYLGHLITPEAMLINIFPDFPAPRRIKYRTVRLPNNPIFSCRFIIFPVSRSAVHIYRKRTIVPIQIFGINKRFRRALRKRNRNQTALADIVIQPNLFPMFLLRYVKPFRLFFQTTEPDSEREIILLRLQRTVIHSSGKAFLRPHRFLHDDNRPVGISEQAGKFRHKSIRIFRYFSCRIAQKPTRINLIGNTCSQPKGKYKCKK

SEQ ID NO: 8241 - DNA, 999 bp, Neisseria gonorrhoeae
atgcacacaccacttacctatattgaccttttctcaggagcaggaggcctatccttgggttttgaacaagccggattccaacaattgctttctgttgaaatggagtctgattattgtcagacttaccgtaccaacttcccccgtcatcaattactgcaaaaagatttaaccacactaaccgaacaagatttaaccaattgtcttaacggacaatcagttgatttggttattggaggaccaccttgtcaaggttttagtatggcaggaaagattggacggacatttacagatgacccacgcaaccatttatttaaagagtttgtccgaatagttaaaattgtccaaccatatttttttgttatggaaaatgtagcgcgactctatacacacaattcaggtaaaacacgtattgagattattcaagcatttcagaatatcggttattcggtggaatgtaagatactgagtgcagccgatttcggtgttcctcagatacgtagccgagtgatatttatcgggaggagggataaaggcaaaatttcctttcccgaacctttgcagatttcccatcagactgttggatcagcaataggacattttccaaaactggctgctggcgaaagcaatccacacgttgcaaatcatgaagctatgaatcattcggcacaaatgttagaaaaaatggcatttgttaaaaatggaggtaaccgtaacgatattcctgaaccattacgtccgaaaacaggtgatatccgtaaatacatccgttacaacagcaacaaaccagccgtttgtattacaggagatatgcgcaaagtttttcactatgaacagaatcgggctttaaccgttcgtgaattagctgccttacaatctttccctgataattttattttttgcggcagcaaaattgcccagcagcagcaggttggtaacgccgtgccgcctttattggcaaaagctattgctgaaagtattttaaaaatgagtgaaaatgaa

SEQ ID NO: 8242 - protein, 333 aa, Neisseria gonorrhoeae
MHTPLTYIDLFSGAGGLSLGFEQAGFQQLLSVEMESDYCQTYRTNFPRHQLLQKDLTTLTEQDLTNCLNGQSVDLVIGGPPCQGFSMAGKIGRTFTDDPRNHLFKEFVRIVKIVQPYFFVMENVARLYTHNSGKTRIEIIQAFQNIGYSVECKILSAADFGVPQIRSRVIFIGRRDKGKISFPEPLQISHQTVGSAIGHFPKLAAGESNPHVANHEAMNHSAQMLEKMAFVKNGGNRNDIPEPLRPKTGDIRKYIRYNSNKPAVCITGDMRKVFHYEQNRALTVRELAALQSFPDNFIFCGSKIAQQQQVGNAVPPLLAKAIAESILKMSENE

SEQ ID NO: 8243 - DNA, 273 bp, Neisseria gonorrhoeae
atgaacgcgtcaaactggagcgtttacctgatattgtgtgaaaacagcgcgttctattgcggtatcagcccgaatccgcaacagcggcttgccatccacacagccggaaaaggcgcgaaatatacccgcgtattcaaaccggtggcgatgcgtatcgttgcaggcggcatggataaaggcactgcgctcaaacaggaaatcgccgtcaaaaaactgaccgccgcacaaaaacggcaattgtgggaacaggcagaaaaaatgccgtctgaaacc

SEQ ID NO: 8244 - protein, 91 aa, Neisseria gonorrhoeae
MNASNWSVYLILCENSAFYCGISPNPQQRLAIHTAGKGAKYTRVFKPVAMRIVAGGMDKGTALKQEIAVKKLTAAQKRQLWEQAEKMPSET

SEQ ID NO: 8245 - DNA, 2415 bp, Neisseria gonorrhoeae
gtgccgccggtaatcaggacggtcataaacaaacattcctttcagattgtatcgggcaaagtatatcagtattatcttcatcttttccaaacgattacccacattgcgccgtcggctgttcagacggcatcacggaggcaatttatgaacatcacccgaatcctctcccaagaactctccgccactaccgtgcaaatcaatgccgctatcgagcttttggacgacggcgcgaccgtcccctttatcgcgcgttaccgtaaagaagccacgggcgggctggacgatacgcagctgcgccagcttgccgagcggctgcaatacctgcgcgagttggaagagcgcaaggccgttgtgttaaaaagcattgaagagcaaggcaagctttcagacgacctcagggcgcaaatcgaagccgccgacaacaaaaccgcgttggaagacctgtacctgccctacaaacccaaacgccgcaccaaagcgcaaatcgcgcacgaacacggtttgcagccgctggcggacgtgttgcttgccgaacagccgcaggacgtggaagccgccgcgcaaggctacctgaacgaaaacatccccgacgccaaagccgcgctggatggcgcgcgcgcgattctgatggagcagtttgccgaagacgcggaactcatcggcacgctgcgcgacaagctgtggaacgaagccgaaatccacacgcaagtcgttgaaggcaaagaaaccgaaggcgaaaaattcagcgattatttcgaccgccgcgaacccgtgcgcgccatgcccagccaccgcgcgctggcggttttgcgcggtcgcaacgaaggcgtgttgaacatcgcgctcaaataccagcccgacgacacgccgattacgcagcaaagcgaatacgagcaaatcatcgcccgccgcttcaaggtttcagacggccacaaatggctgcgcgacaccgtgcgcctgacttggcgcgcgaaaatctttttgtcgctggaactcgaagctctcaatcgtttgaaagaagctgccgacactgacgcgattaccgtgttcgcccgcaatctcaaagacttgctgctcgccgcgcccgccgggcggctgaccactttgggactcgaccccggctaccgcaacggcgtgaaatgcgccgtggtggacgacacgggcaaactgctggatacggtcattgtctatttgcatcaagaaaacaatatgttggcaacgttgtcgcgcctgattaaacaacacggtgtgaagctcatcgccatcggcaacggcaccgccagccgcgaaaccgacaaaatcgcgggcgaactggtgcgcggaatgcccgaaagcagcctgcacaaaatcgtcgtttccgaagccggcgcgtcgatttattctgcgtccgaactggcggcgcgcgagtttcccgacttagatgtttccctgcgcggcgcagtgtccatcgcccgcaggctgcaagacccgcttgccgagttggtcaaaatcgaccccaaatccatcggcgtggggcagtatcagcacgacgtgaaccaaagccggctcgccaaatcgctggacgcggtggtcgaagactgcgtgaacgccgtcggcgtggacgcgaacaccgcctccgccccgctcttggcgcggatttccggtttaaatcaaacccttgcccaaaacatcgtcgcctaccgtgatgaaaacggcgcgttcgacagccgaaaaaaattgctaaaagtaccgcgcttgggcgaaaaaaccttcgagcaagcagcaggctttttgcggattaacggcggcaaagagccgctggacgcgagcgccgtccaccccgaagcctatcccgtcgtcgccaaaatgctggcgcaacaaggcattaccgccgccgaactcatcggcaaccgcgagcgtgtgaagcaaatcaaagcatccgacttcaccgacgaacgcttcggtctgccgactattttggacatcctgtccgagctggaaaaacccggccgcgacccgcgcggtgcgtttcagacggcatcgtttgccgaaggcatccacgaaatcagcgacttgcaagtcggcatgatactcgagggcgtggtctccaacgtcgccaacttcggcgcgttcgtggacatcggcgtccatcaggacggcttggtgcacatctccgccctgtctaataagttcgtccaagacccgcgcgaagtggtgaaagccggcgacgtggtgaaagtgaaagtgctggaagtcgatgccgcacgcaaacgcatcgcgctgaccatgcgcttggatgacgaaccgggcggcgcaaaacataaaatgccgtctgaaaaccgcagccgcgaacggacagccggccgcaaaccccaacgcaacgaccgcgccccgaccaattcggcgatggcggatgcgtttgcgaagctgaagcgg

SEQ ID NO: 8246 - protein, 805 aa, Neisseria gonorrhoeae
VPPVIRTVINKHSFQIVSGKVYQYYLHLFQTITHIAPSAVQTASRRQFMNITRILSQELSATTVQINAAIELLDDGATVPFIARYRKEATGGLDDTQLRQLAERLQYLRELEERKAVVLKSIEEQGKLSDDLRAQIEAADNKTALEDLYLPYKPKRRTKAQIAHEHGLQPLADVLLAEQPQDVEAAAQGYLNENIPDAKAALDGARAILMEQFAEDAELIGTLRDKLWNEAEIHTQVVEGKETEGEKFSDYFDRREPVRAMPSHRALAVLRGRNEGVLNIALKYQPDDTPITQQSEYEQIIARRFKVSDGHKWLRDTVRLTWRAKIFLSLELEALNRLKEAADTDAITVFARNLKDLLLAAPAGRLTTLGLDPGYRNGVKCAVVDDTGKLLDTVIVYLHQENNMLATLSRLIKQHGVKLIAIGNGTASRETDKIAGELVRGMPESSLHKIVVSEAGASIYSASELAAREFPDLDVSLRGAVSIARRLQDPLAELVKIDPKSIGVGQYQHDVNQSRLAKSLDAVVEDCVNAVGVDANTASAPLLARISGLNQTLAQNIVAYRDENGAFDSRKKLLKVPRLGEKTFEQAAGFLRINGGKEPLDASAVHPEAYPVVAKMLAQQGITAAELIGNRERVKQIKASDFTDERFGLPTILDILSELEKPGRDPRGAFQTASFAEGIHEISDLQVGMILEGVVSNVANFGAFVDIGVHQDGLVHISALSNKFVQDPREVVKAGDVVKVKVLEVDAARKRIALTMRLDDEPGGAKHKMPSENRSRERTAGRKPQRNDRAPTNSAMADAFAKLKR

SEQ ID NO: 8247 - DNA, 153 bp, Neisseria gonorrhoeae
ttgcgggaaaagatttgcccgataaaacctgatttcgatgcagtcatcgttcgtacagccaaaaaacaaaagcctattgtagcaaatatcgcccgcctgctgaaaaatgccgccacgcgccgccggtttgccgttccaatgcaaaatgccgtc

SEQ ID NO: 8248 - protein, 51 aa, Neisseria gonorrhoeae
LREKICPIKPDFDAVIVRTAKKQKPIVANIARLLKNAATRRRFAVPMQNAV

SEQ ID NO: 8249 - DNA, 1020 bp, Neisseria gonorrhoeae; identical to SEQ ID NO: 7407

SEQ ID NO: 8250 - protein, 340 aa, Neisseria gonorrhoeae; identical to SEQ ID NO: 7408

SEQ ID NO: 8251 - DNA, 1233 bp, Neisseria gonorrhoeae
atgcttgtctgtatttttacggggtttgcctcggggctgccgctgtactttctgattaacctgattccggcgtggttgcgcagcgagcaggtggatttgaagagcatcgggctgatggcgttgatcggtctgccgtttacttggaaatttttgtggtcgccgctgatggacgcggtcaggctgcccgttttgggacggcggcgcgggtggatgctgctgacgcaggcagggttactggcggctttggcggcatatgcctttttaaacccccggaatcatctgccgttgattgccggcttgtcggtgcttgtcgcttttttttccgccagtcaggacattgtattggatgcgttcaggcgcgagattttgtcggacgaagaattgggtttgggcaactcggttcatgtgaacgcctaccgggttgccgccctgattcccggttcattgagtttggtgttggcagacaggatgccgtggtcagaagtatttgttatcacttcattatttatgctgcccggccttctgatgacgctgtttctcgcgcacgaacccgtgttgccgccttccgttcctaaaacgttgaagcagaccgtggtagagccgtttaaagaattttttatgcgcaagggcatcgcttcggcggtgtgcgtgctgctgtttatcttcctttacaaactcggcgacagtatggcaaccgcgttggcaacgccgttttatctggatatgggtttcagcaagaccgacatcggtttgattgccaaaaatgcaggactgtggccggcagtggcggcaggtatcttgggcggcgtgtggatgctgaaaatcggcgtaaacaaagccttgtggctattcggcgcggtgcaggcaataacggttttggggtttgtatggctggcagggttcggacatttcgacacggtcggcacaggcgagaggctgatgctggcggcagttatcggcgcggaagcggtcggcgtggggttggggacggcggcgttcgtatcgtatatggcgcgcgagaccaatcccgcgtttacggcaacgcagcttgcgctgtttaccagcctgtccgccgtgccgcgcacggtcatcaattcctttgcaggctatctgatcgaatggatgggttatgtaccgtttttccggctgtgtttcatacttgccctgccgggtatgctgctgctgctgaaagttgcgccttggaacggggaaaaaacccaggatgcaggcaga

SEQ ID NO: 8252 - protein, 411 aa, Neisseria gonorrhoeae
MLVCIFTGFASGLPLYFLINLIPAWLRSEQVDLKSIGLMALIGLPFTWKFLWSPLMDAVRLPVLGRRRGWMLLTQAGLLAALAAYAFLNPRNHLPLIAGLSVLVAFFSASQDIVLDAFRREILSDEELGLGNSVHVNAYRVAALIPGSLSLVLADRMPWSEVFVITSLFMLPGLLMTLFLAHEPVLPPSVPKTLKQTVVEPFKEFFMRKGIASAVCVLLFIFLYKLGDSMATALATPFYLDMGFSKTDIGLIAKNAGLWPAVAAGILGGVWMLKIGVNKALWLFGAVQAITVLGFVWLAGFGHFDTVGTGERLMLAAVIGAEAVGVGLGTAAFVSYMARETNPAFTATQLALFTSLSAVPRTVINSFAGYLIEWMGYVPFFRLCFILALPGMLLLLKVAPWNGEKTQDAGR

SEQ ID NO: 8253 - DNA, 1530 bp, Neisseria gonorrhoeae
ttgctactgaaacccgacggtttacaggctgtaatacatttcaaattccagcgggtgcggcgccatacggatgcggcggacatcttcctctttaaaggcgatgtagctgtcgatccagtctttgctgaacacgccgccgcgcagcaggaattcgtggtcggccttgagggcggcaagtgcttcttccaaagaagcgcagacggtcgggacgagcgcgtcttcttccggcggcaggtcgtacaggtttttatcggcagggtcgcccggatggattttgttttgaatgccgtccaaaccggccatcagcagggcggcaaatgccaaatacgggttggcggtcgggtcggggaaacgcgcttcgatgcggcgcgccttgctgctgttcacagacgggatacggatggaagcggaacggtttttggcggaataggccaatttggtcggtgcttcaaagtgcggcacgaggcgtttgtaggagttggtggacggattggtaatcgcgttcagggctttggcgtgtttgatgatgccgccgatgtagtagagcgcggtatcggacaaaccggcatagccgtcgcctgcgaacaggttttgaccgtctttccaaatggattggtggacgtgcataccgctgccgttgtcgcccataatcggtttgggcataaaggtggcggttttgccgaaattgtgggcaacgttttggatgacgtatttcatatcttgggtttggtcggcgcgtttgaccaaagtggcgaaacgggtgccgatttccatttggctgccggtaccgacttcgctgtggtggacttcgacttcgatgccgagtccttccaaaatgttcaccatggcggagcgcaaatcttgaccgcagtcaatcggcgcgacgggcgcgtagccgcctttgacggcggggcggtggccggtgttttgaccgtccatatgcaggccgcttgcccacgcgccgctttcggacgtgatttcgtaacgggttttgtgcatgtcggtttcaaattctacgccgtcgaagacgaagaattcgggttcggggccgaaataggcggtgtcgccgataccggaagatttcaaataggcttcggcgcgacgtgcgatggagcgcgggtcgcggtcgtaaccctgaccgtcggcagggtcgatgacgtcgcaggtaatgacgacggtaacatcatcataaaaaggatcgacgaaggctgtggacgcatcggggcgcaactgcatatcggaagcctcaatgcctttccagccgccgatggacgagccgtcaaacgccggtccgttttcaaaccactcttcggggtcttccaacacgatgcgcgcaggcacggtaaagtggtgctgcttgcctttggtatcggtgaagcgcaaatcgacaaagcgggcttcgctttcttcaatcaattttacggcgtttttaatggacatcttcagctcctgaaaaagggaaatggcaaaatatgcggaacgcggcggcttgacgcaaagtcggcacgattttaccacgccgatgccgtc

SEQ ID NO: 8254 - protein, 510 aa, Neisseria gonorrhoeae
LLLKPDGLQAVIHFKFQRVRRHTDAADIFLFKGDVAVDPVFAEHAAAQQEFVVGLEGGKCFFQRSADGRDERVFFRRQVVQVFIGRVARMDFVLNAVQTGHQQGGKCQIRVGGRVGETRFDAARLAAVHRRDTDGSGTVFGGIGQFGRCFKVRHEAFVGVGGRIGNRVQGFGVFDDAADVVERGIGQTGIAVACEQVLTVFPNGLVDVHTAAVVAHNRFGHKGGGFAEIVGNVLDDVFHILGLVGAFDQSGETGADFHLAAGTDFAVVDFDFDAESFQNVHHGGAQILTAVNRRDGRVAAFDGGAVAGVLTVHMQAACPRAAFGRDFVTGFVHVGFKFYAVEDEEFGFGAEIGGVADTGRFQIGFGATCDGARVAVVTLTVGRVDDVAGNDDGNIIIKRIDEGCGRIGAQLHIGSLNAFPAADGRAVKRRSVFKPLFGVFQHDARRHGKVVLLAFGIGEAQIDKAGFAFFNQFYGVFNGHLQLLKKGNGKICGTRRLDAKSARFYHADAV

SEQ ID NO: 8255 - DNA, 1038 bp, Neisseria gonorrhoeae; identical to SEQ ID NO: 7425

SEQ ID NO: 8256 - protein, 346 aa, Neisseria gonorrhoeae; identical to SEQ ID NO: 7426

SEQ ID NO: 8257 - DNA, 1572 bp, Neisseria gonorrhoeae
ttgttgacaatcttgccgtttgaaactatattttccggcttggaatttgacgcaaaaccggtttcagacggcatcggcgtggtaaaatcgtgccgactttgcgtcaagccgccgcgttccgcatattttgccatttccctttttcaggagctgaagatgtccattaaaaacgccgtaaaattgattgaagaaagcgaagcccgctttgtcgatttgcgcttcaccgataccaaaggcaagcagcaccactttaccgtgcctgcgcgcatcgtgttggaagaccccgaagagtggtttgaaaacggaccggcgtttgacggctcgtccatcggcggctggaaaggcattgaggcttccgatatgcagttgcgccccgatgcgtccacagccttcgtcgatcctttttatgatgatgttaccgtcgtcattacctgcgacgtcatcgaccctgccgacggtcagggttacgaccgcgacccgcgctccatcgcacgtcgcgccgaagcctatttgaaatcttccggtatcggcgacaccgcctatttcggccccgaacccgaattcttcgtcttcgacggcgtagaatttgaaaccgacatgcacaaaacccgttacgaaatcacgtccgaaagcggcgcgtgggcaagcggcctgcatatggacggtcaaaacaccggccaccgccccgccgtcaaaggcggctacgcgcccgtcgcgccgattgactgcggtcaagatttgcgctccgccatggtgaacattttggaaggactcggcatcgaagtcgaagtccaccacagcgaagtcggtaccggcagccaaatggaaatcggcacccgtttcgccactttggtcaaacgcgccgaccaaacccaagatatgaaatacgtcatccaaaacgttgcccacaatttcggcaaaaccgccacctttatgcccaaaccgattatgggcgacaacggcagcggtatgcacgtccaccaatccatttggaaagacggtcaaaacctgttcgcaggcgacggctatgccggtttgtccgataccgcgctctactacatcggcggcatcatcaaacacgccaaagccctgaacgcgattaccaatccgtccaccaactcctacaaacgcctcgtgccgcactttgaagcaccgaccaaattggcctattccgccaaaaaccgttccgcttccatccgtatcccgtctgtgaacagcagcaaggcgcgccgcatcgaagcgcgtttccccgacccgaccgccaacccgtatttggcatttgccgccctgctgatggccggtttggacggcattcaaaacaaaatccatccgggcgaccctgccgataaaaacctgtacgacctgccgccggaagaagacgcgctcgtcccgaccgtctgcgcttctttggaagaagcacttgccgccctcaaggccgaccacgaattcctgctgcgcggcggcgtgttcagcaaagactggatcgacagctacatcgcctttaaagaggaagatgtccgccgcatccgtatggcgccgcacccgctggaatttgaaatgtattacagcctg

SEQ ID NO: 8258 - protein, 524 aa, Neisseria gonorrhoeae
LLTILPFETIFSGLEFDAKPVSDGIGVVKSCRLCVKPPRSAYFAISLFQELKMSIKNAVKLIEESEARFVDLRFTDTKGKQHHFTVPARIVLEDPEEWFENGPAFDGSSIGGWKGIEASDMQLRPDASTAFVDPFYDDVTVVITCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDCGQDLRSAMVNILEGLGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDALVPTVCASLEEALAALKADHEFLLRGGVFSKDWIDSYIAFKEEDVRRIRMAPHPLEFEMYYSL

SEQ ID NO: 8259 - DNA, 381 bp, Neisseria gonorrhoeae; identical to SEQ ID NO: 1319

SEQ ID NO: 8260 - protein, 127 aa, Neisseria gonorrhoeae; identical to SEQ ID NO: 1320

SEQ ID NO: 8261 - DNA, 972 bp, Neisseria gonorrhoeae
cgacaccctgaccaaagattccttcgccagctgaatcatagcatccttcacttcgctgtcggacagggcatccaacgcggcaacggcacaatcgactgctttgcgcgcctcgcctatcgaatatgccaaagcatccgaacggacgacataatcgcggattttttcaaaatagccgcgatctgcattttccaaagcagtacgcacatcgttcgcaacctgttcggaaccctgacgcatcagataaatcaaaggcagggtcggttttccttccgccaaatcgtcgccgacgtttttacctgtttcttcggtttcccccgaataatccagcacatcgtcaataatctggaatgccgtaccgacgtacataccgtagtctttcaaggcctgttcgtgcccgggggaagctttgcccaaaattgcgccgacttgagcggcagcttcaaacaattttgccgttttatattggatgactcggatatattgttcttcggtaatgtccgtattgccgatgttcatcagctgcatgacctctccctcggcaatgatgttggtcgcatccgccatcacttccaaaacgcgcatactgcccgaggcaaccatcagttgaaatgcacgggtatataaaaagtcgccaaccaacactgccgccgcattgccgaacagattgtttgccgttgcccgcccacggcgcaaatcgctttcatcgacgacatcgtcgtgcaggagtgtggaagtgtggataaactcgaccatcgctgccagcgaatacagtttctcgtcatcataaccgaccgccttacccgccaaaatcgtcataatcggacgcaggcgtttgccgcccgcgctgatgatatatgtaccgatttgcgaaatcagtgcgacatcggattgcaccgcacggttgatgacttcattgactttggcaaggtcttcaggcagatgtcgctggaaatagggcagattctcgagcat

SEQ ID NO: 8262 - protein, 207 aa, Neisseria gonorrhoeae
RHPDQRFLRQLNHSILHFAVGQGIQRGNGTIDCFARLAYRICQSIRTDDIIADFFKIAAICIFQSSTHIVRNLFGTLTHQINQRQGRFSFRQIVADVFTCFFGFPRIIQHIVNNLECRTDVHTVVFQGLFVPGGSFAQNCADLSGSFKQFCRFILDDSDILFFGNVRIADVHQLHDLSLGNDVGRIRHHFQNAHTARGNHQLKCTGI

SEQ ID NO: 8263 - DNA, 135 bp, Neisseria gonorrhoeae
ttgtcaacaatatgcttcggtttgtctgttcaaaagcggaatgcccgcccttttgtccgaatgccgacaaaacagatgccgtctgaaggcggtttcagacggcatcgttcccatcttcgcgccgccgttataaaa

SEQ ID NO: 8264 - protein, 45 aa, Neisseria gonorrhoeae
LSTICFGLSVQKRNARPFVRMPTKQMPSEGGFRRHRSHLRAAVIK

SEQ ID NO: 8265 - DNA, 837 bp, Neisseria gonorrhoeae
atgaccgccccgcctttatggaatatgactatgcacgccctcccccgctacgccgttttcggcaaccccgccgcccacagcaaatcgccgcagattcatcagcaatttgcccttcaggaaggcgttgacatcgaatacggacgcatttgcgccgacatcggcggtttcgcgcaggcggtttcgacattttttgaaacaggcggttgcggggcaaacgttaccgtaccgttcaaacaggaagcgtttcatctggcggacgaacattccgaccgcgctttggctgccggtgcggtcaatacgctggtgtggttggaagacggcagaatacgcggcgacaataccgacggtatcggtttggccaacgacatcacgcaggtcaaaaacattgccatcgagggcaaaaccatcttgcttttgggcgcgggcggcgcggtgcgcggcgtgattccggttttgaaagaacaccgccctgcccgtatcgtcattgccaaccgtacccgcgccaaagccgaggaattggcgcggcttttcggcattgaagccgtcccgatggcggatgtgaacggcggtttcgatatcatcatcaacggcacgtccggcggcttgagcggtcagcttcctgccgtcagccctaaaattttccgcgactgccgccttgcctacgatatggtttacggcgaagcggcaaaaccgtttttagattttgcacgacaatcgggtgcgaaaaaaactgccgacggactgggtatgctagtcggtcaggcggcggcttcctacgccctctggcgcggtttcaaaccggacatccgccccgtcatcgaacacatgaaagccctg

SEQ ID NO: 8266 - protein, 279 aa, Neisseria gonorrhoeae
MTAPPLWNMTMHALPRYAVFGNPAAHSKSPQIHQQFALQEGVDIEYGRICADIGGFAQAVSTFFETGGCGANVTVPFKQEAFHLADEHSDRALAAGAVNTLVWLEDGRIRGDNTDGIGLANDITQVKNIAIEGKTILLLGAGGAVRGVIPVLKEHRPARIVIANRTRAKAEELARLFGIEAVPMADVNGGFDIIINGTSGGLSGQLPAVSPKIFRDCRLAYDMVYGEAAKPFLDFARQSGAKKTADGLGMLVGQAAASYALWRGFKPDIRPVIEHMKAL

SEQ ID NO: 8267 - DNA, 699 bp, Neisseria gonorrhoeae
atgttccgcatcgtcaaatggctgattgccctgcccgtcggcatctttatctttttcaatgcctatgtgtacggcaacatcatcacctaccgcgccgtcgcgccccatcggactgcctttatgtcgatgcggatgaagcagtttgaacaagaaggtcgcgatgtcgcactggattaccgctgggtgccctacaaccgcatttccaccaacctgaaaaaagccctgattgcttccgaagatgtccgttttgccggacacggcggcttcgattgggacggcattcaaaacgccatcaggcgcaaccggaacagcggcgaagtgaaggcgggcggatcgaccatcagccagcagcttgccaaaaacctcttcctcaacgaaagccgcaactatctgcgcaaaggggaagaggcggccattacggcaatgatggaagctgttaccgacaaaaacaggattttcgaactgtatttaaactcaatcgaatggcactacggcgttttcggcgcggaagctgcgtcccggtatttttataaaaaaccggccgcagacctgaccaaacagcaggcggcgaaactgacggcactcgtccccgccccgctctactacgctgaccatccgaaaagcaaacggctgcgcaacaaaaccaatatcgtgctcagacgcatgggttcggcagaattacccgaaagcgatacggac

SEQ ID NO: 8268 - protein, 233 aa, Neisseria gonorrhoeae
MFRIVKWLIALPVGIFIFFNAYVYGNIITYRAVAPHRTAFMSMRMKQFEQEGRDVALDYRWVPYNRISTNLKKALIASEDVRFAGHGGFDWDGIQNAIRRNRNSGEVKAGGSTISQQLAKNLFLNESRNYLRKGEEAAITAMMEAVTDKNRIFELYLNSIEWHYGVFGAEAASRYFYKKPAADLTKQQAAKLTALVPAPLYYADHPKSKRLRNKTNIVLRRMGSAELPESDTD

SEQ ID NO: 8269 - DNA, 1008 bp, Neisseria gonorrhoeae; identical to SEQ ID NO: 7435

SEQ ID NO: 8270 - protein, 336 aa, Neisseria gonorrhoeae; identical to SEQ ID NO: 7436

SEQ ID NO: 8271 - DNA, 555 bp, Neisseria gonorrhoeae; identical to SEQ ID NO: 7443

SEQ ID NO: 8272 - protein, 185 aa, Neisseria gonorrhoeae; identical to SEQ ID NO: 7444

SEQ ID NO: 8273 - DNA, 270 bp, Neisseria gonorrhoeae
ttggtagagcaacggattgaaaatccgtgtgtcggcggttcgattccgcctctggccaccaaaaaaccgattataagcggttattttttgcctgccgttttcggcagcagtcccgcaccgcaaatacctgccatgcacgacatggtctttgcggctgtcgggcaggttagtggattaacaaaaatcaggacaaagcgacgaagccgcagacagtacaacatagtacggcaaggcggggtaacgccgtaccggtttaaatttaatccacta

SEQ ID NO: 8274 - protein, 90 aa, Neisseria gonorrhoeae
LVEQRIENPCVGGSIPPLATKKPIISGYFLPAVFGSSPAPQIPAMHDMVFAAVGQVSGLTKIRTKRRSRRQYNIVRQGGVTPYRFKFNPL

SEQ ID NO: 8275 - DNA, 195 bp, Neisseria gonorrhoeae
gtgcgtattaaaccaaatttcgggacgacacgcaagcggatttgtcgatattttttacccaaccgactaagtcgatgttttaagtttaaattaatttcacagaaaaatagtgcaaatcggttttttgccgttcgttcggcgatgttctgctttgcagacggcaaaacgcttcaatatttgaagttctcgcccaaa

SEQ ID NO: 8276 - protein, 65 aa, Neisseria gonorrhoeae
VRIKPNFGTTRKRICRYFLPNRLSRCFKFKLISQKNSANRFFAVRSAMFCFADGKTLQYLKFSPK

SEQ ID NO: 8277 - DNA, 732 bp, Neisseria gonorrhoeae
atgagcgcaaacaacagccgcctcgtcgtccaaaacctgcagaaaagtttcaaaaaacgccaagtcgtcaaaagtttctcccttgagatcgaaagcggcgaagtcatcggactgctcgggcccaacggcgcaggcaaaaccaccggcttctacatgatagtcgggctcatcgctgccgacgcaggcagcgtgatgctggacgggcgggaattgcgccacctgcccatacacgaacgcgcccgcctgggtgtcggctacctgccgcaggaagcctcgatattccgcaaaatgaccgtcgaacaaaacatccgcgccatcttggaaatcagaaccaaagataaaaatcaaatcgacagagaaatcgaaaaactgctcgccgacctcaatatcggacacttgcgccgcaatcctgcgccgtcgctgtccggcggcgaacggcggcgcgtcgaaatcgcccgtgtcctcgccatgaaaccacgtttcatccttttggacgaaccttttgccggcgtcgatcccatcgccgtcatcgacatccagaaaatcatcggtttcctcaaatcgcgcggcatcggcgtattgattaccgaccacaacgtccgcgagaccctcagcatctgcgaccgcgcctacatcatttcagacggtgcggtgctggcttccggcaagcccgacgatttggtcggcaacgaacaggtgcgcgccgtctatttgggcgagaacttcaaatat

SEQ ID NO: 8278 - protein, 244 aa, Neisseria gonorrhoeae
MSANNSRLVVQNLQKSFKKRQVVKSFSLEIESGEVIGLLGPNGAGKTTGFYMIVGLIAADAGSVMLDGRELRHLPIHERARLGVGYLPQEASIFRKMTVEQNIRAILEIRTKDKNQIDREIEKLLADLNIGHLRRNPAPSLSGGERRRVEIARVLAMKPRFILLDEPFAGVDPIAVIDIQKIIGFLKSRGIGVLITDHNVRETLSICDRAYIISDGAVLASGKPDDLVGNEQVRAVYLGENFKY

SEQ ID NO: 8279 - DNA, 2016 bp, Neisseria gonorrhoeae
atgaataaatctttatccggttcggtagaaaaataccgcgaactgacgctccgaggcatgatactcggcgcattgatcactgtaatttttactgcgtctaacgtttacctcggtttgaaagtcgggctgacctttgcctcgtcgattccggcggcggtgatttcgatggcggttttaaaatttttcaaaggcagcaatattttggaaaacaacatggtgcagacccaagcctcggctgcgggtacgctttcaaccatcatcttcgtcctgcccggtttgctgatggcgggctactggagcggtttcccgttttggcagacgacgcttttatgtattgccggcgggattttgggggtgattttcaccattccgctgcgttacgcgatggtggtgaaaagcgatttgccttatccggaaggtgtggcggctgctgaaattttgaaagtgggcggtcatgaagaaggggatgaccgtcagggcggcagcggtatcaaagagctggcggccggcggcgcgttggcgggattgatgagcttttgctccggaggtctgcgtgtgattgccgatagcgcgagttattggtttaaaagcggtacggcaattttccaactgccgataggcttttcactggccttgttgggcgcgggttatttggtcggactgacgggcggcatcgccatcctgctgggcatttcgattgcttggggtattgccgtgccgtatttctcctcacacattccgcaaccttccgatatggaaatggcggcgtttgcgatgaagctgtggaaggaaaaagtgcgttttatcggtgcgggaaccataggtatcgcggcggtttggacgcttttgatgctgctcaagccaatggtggaaggcatgaagatgtcgttcaagagttttggcggcggtgcgcccgctacagaacgcgccgaacaggatttgtcgcctaaagccatgattttctgggtgttgtctatgatgtttattctaggcgtgtcgttttaccactttatcggcgattcgcacattacgggcggcatggcgtggcttttggtggcggtttgcacgcttttggcttccgtcatcggctttttggtcgccgccgcctgcggttatatggcaggtttggtcggctcgtcttccagcccgatttccggcgtgggcatcgtgtccatcgtcgttatttcactggttttgctgctggtaggcgaatccggaggtttgttggcggatgaggccaaccgcaaattcttactggcgttgacgcttttttgcggatcggcagtaatctgcgtggcttcgatttccaacgacaacctgcaagacttgaaaaccggctacctgctcaaagctacgccttggcggcagcaagtcgccctgattatcggctgtatcgttggtgcgctggttatttcgcccgtgttggaactgctttacgaagcctacggctttaccggcgcaatgccgcgcgaaggcatggatgcggcgcaggctttggcagcccttcaagcgactttgatgacgaccattgcgtcgggcattttcgcccacaacctcgaatgggcgtacatctttaccggtatcgcgattggagcggtattaatcgtcgtcgatttggtgttgaaaaaatcatcaggcggtaaacttgccctgcccgtccttgcggtcggtatgggcatttatctgccgccgtccgtcaatatgcccatcgtggcaggcgcggtgttggcggcggtgttgaaacacatcattggcaagaaggcggaaaaccgcgaaggccgtctgaaaaacgccgaccgtatcggtacgcttttcgcggcaggcctgattgtcggtgaaagcctgattggtgtaattatggcgtttattattgccttctctgtgaccaacggcggctcggatgcgccgctcgcgttgaatctgcaaaactgggatgccgccgcttcttggttgggcttggcgttcttcgttaccgggatgtttttctttgcacagcgcgtactgaaggcgggtagg

SEQ ID NO: 8280 - protein, 672 aa, Neisseria gonorrhoeae
MNKSLSGSVEKYRELTLRGMILGALITVIFTASNVYLGLKVGLTFASSIPAAVISMAVLKFFKGSNILENNMVQTQASAAGTLSTIIFVLPGLLMAGYWSGFPFWQTTLLCIAGGILGVIFTIPLRYAMVVKSDLPYPEGVAAAEILKVGGHEEGDDRQGGSGIKELAAGGALAGLMSFCSGGLRVIADSASYWFKSGTAIFQLPIGFSLALLGAGYLVGLTGGIAILLGISIAWGIAVPYFSSHIPQPSDMEMAAFAMKLWKEKVRFIGAGTIGIAAVWTLLMLLKPMVEGMKMSFKSFGGGAPATERAEQDLSPKAMIFWVLSMMFILGVSFYHFIGDSHITGGMAWLLVAVCTLLASVIGFLVAAACGYMAGLVGSSSSPISGVGIVSIVVISLVLLLVGESGGLLADEANRKFLLALTLFCGSAVICVASISNDNLQDLKTGYLLKATPWRQQVALIIGCIVGALVISPVLELLYEAYGFTGAMPREGMDAAQALAALQATLMTTIASGIFAHNLEWAYIFTGIAIGAVLIVVDLVLKKSSGGKLALPVLAVGMGIYLPPSVNMPIVAGAVLAAVLKHIIGKKAENREGRLKNADRIGTLFAAGLIVGESLIGVIMAFIIAFSVTNGGSDAPLALNLQNWDAAASWLGLAFFVTGMFFFAQRVLKAGR

SEQ ID NO: 8281 - DNA, 114 bp, Neisseria gonorrhoeae
ttgaaaataaaaactatttccaaacgaacaaaaacagccgtatcagggaggttccccgatacggctgcttgtttccgaaccttaaaatcaatcaaacaaatcgcgcagcttgtc

SEQ ID NO: 8282 - protein, 38 aa, Neisseria gonorrhoeae
LKIKTISKRTKTAVSGRFPDTAACFRTLKSIKQIAQLV

SEQ ID NO: 8283 - DNA, 1032 bp, Neisseria gonorrhoeae
atgaaataccatcccgaccgcaatcctgacaataaagaggcggaagagaagtttaaagaagtacaaaaggcgtatgaaactttgtccgacaaggaaaagcgtgccatgtacgaccagtatggtcatgcggcgtttgaaggcggcggacaggggggcttcggagggtttggcggatttggcggtgcgcagggttttgactttggggatattttcagccaaatgtttggaggtggttcggggcgcgcccagcctgattatcagggtgaggacgtgcaggtcggtatcgaaatcacgcttgaagaagccgcaaaaggtgtgaagaaacgcatcaatattccgacttatgaagcgtgtgatgtctgcaacggcagcggcgcgaaaccgggggcatccccggaaacctgcccgacttgcaaaggttcgggtacggtgcacatccagcaggcgattttccgtatgcagcagacttgtccgacctgccgcggtgcgggcaaacatattaaagaaccttgcgtcaaatgccgtggcgtggggcggaataaggcggtcaagacggtggaagtcaatattcccgccggtatcgatgacgggcagcgtatccgtttgagcggtgaaggcgggccgggtatgcacggcgcgcctgccggcgacctgtatgtaaccgtccgcattcgggcgcataagattttccaacgcgatggtttggatttgcattgcgaactgccgattagttttgccatggctgctttgggcggggagttagaagtgccgaccttggacggcaaagtcaagctcaccgtccccaaagaaacccaaaccggcaggaggatgcgcgtgaaaggtaagggtgtcaaatctttacgcagcagcgcgaccggcgatttgtactgccatattgttgtcgaaacgcctgtcaatttgaccgaccgtcaaaaagagcttttggaagaatttgagcggatttctacgggcttggaaaaccaaacgccgcgcaagaaatcgtttttagacaagctgcgcgatttgtttgat

SEQ ID NO: 8284 - protein, 344 aa, Neisseria gonorrhoeae
MKYHPDRNPDNKEAEEKFKEVQKAYETLSDKEKRAMYDQYGHAAFEGGGQGGFGGFGGFGGAQGFDFGDIFSQMFGGGSGRAQPDYQGEDVQVGIEITLEEAAKGVKKRINIPTYEACDVCNGSGAKPGASPETCPTCKGSGTVHIQQAIFRMQQTCPTCRGAGKHIKEPCVKCRGVGRNKAVKTVEVNIPAGIDDGQRIRLSGEGGPGMHGAPAGDLYVTVRIRAHKIFQRDGLDLHCELPISFAMAALGGELEVPTLDGKVKLTVPKETQTGRRMRVKGKGVKSLRSSATGDLYCHIVVETPVNLTDRQKELLEEFERISTGLENQTPRKKSFLDKLRDLFD

SEQ ID NO: 8285 - DNA, 168 bp, Neisseria gonorrhoeae
ttgataaagcttactgctttgttgtgtcttaatcctgccttttgtgtttcaggattaagtcgatacaatcatcacccaaatactatgtttgttttcttttctcttgcgagaggtttttatcctttgcaaagaataaaaaatcaaaacaaactcattgtctttgtttgt

SEQ ID NO: 8286 - protein, 56 aa, Neisseria gonorrhoeae
LIKLTALLCLNPAFCVSGLSRYNHHPNTMFVFFSLARGFYPLQRIKNQNKLIVFVC

SEQ ID NO: 8287 - DNA, 588 bp, Neisseria gonorrhoeae
atgcttttgtttatcgacaattacgacagttttacttacaacatcgtccagtatttcgcagaattggggcaggaagtcgccgtgcgccgcaacgatgatattacgttggaggaaatcgaggcattgaatccgcaatatctcgttatcggtcccggaccgtgttcccctaaggaggcgggtatttcagtagaagccatgcgccattttgccggccggctgccgattatgggcgtgtgcctcgggcatcagacgataggcgaagcgttcggtggagatgtggtacgggcaaaaaccttgatgcacggtaaggtgtcgcccgtgtcccattcgggcaagggtatgtttaagggtttgcccaatccggttacctgtacgcgttatcacagcctcgttatcgaacgcggcacgctgccggattgcttggaaatcacggcgtggacggaagacggcgaaattatgggcgtgcgccataaggaatatgccgtcgagggcgtgcagttccaccccgaagccctcttgaccgaacgcggacatgatatgttgaacaattttttagttgaatttcaaaacttcaaaccgcaaaaaatc

SEQ ID NO: 8288 - protein, 196 aa, Neisseria gonorrhoeae
MLLFIDNYDSFTYNIVQYFAELGQEVAVRRNDDITLEEIEALNPQYLVIGPGPCSPKEAGISVEAMRHFAGRLPIMGVCLGHQTIGEAFGGDVVRAKTLMHGKVSPVSHSGKGMFKGLPNPVTCTRYHSLVIERGTLPDCLEITAWTEDGEIMGVRHKEYAVEGVQFHPEALLTERGHDMLNNFLVEFQNFKPQKI

SEQ ID NO: 8289 - DNA, 447 bp, Neisseria gonorrhoeae; identical to SEQ ID NO: 7469

SEQ ID NO: 8290 - protein, 149 aa, Neisseria gonorrhoeae; identical to SEQ ID NO: 7470

SEQ ID NO: 8291 - DNA, 528 bp, Neisseria gonorrhoeae
atgatacaaaagatatgtaagctatttgttttaattgtaatttttgcaacttctcccgcttttgcccttcaaagcgacagcagacggcccatccaaatcgaagccgaccaaggttcgctcgatcaagccaaccaaagtaccacatttagcggcaatgtcatcatcagacagggtacgctcaacatttccgcctcgcgcgtcaacgtcacacgcggcggcaaaggcggcgaatccgtgagggcggaaggttcgcccgtccgcttcagccaaacgttggacgggggcaaagggacggtgcgcggtcaggcaaacaacgttacctattcctccgcaggaagcaccgtcgttctgaccggcaatgccaaagtgcagcgcggcggcgacgttgccgaaggtgcggtcattacctacaacaccaaaaccgaagtctataccatcaacggcagcacgaaatcgggtgcgaaatccgcttccaaaaccggcagggtcagcgtcgtcatccagccttcaagcacacaaaaaaccgaa

SEQ ID NO: 8292 - protein, 176 aa, Neisseria gonorrhoeae
MIQKICKLFVLIVIFATSPAFALQSDSRRPIQIEADQGSLDQANQSTTFSGNVIIRQGTLNISASRVNVTRGGKGGESVRAEGSPVRFSQTLDGGKGTVRGQANNVTYSSAGSTVVLTGNAKVQRGGDVAEGAVITYNTKTEVYTINGSTKSGAKSASKTGRVSVVIQPSSTQKTE

SEQ ID NO: 8293 - DNA, 579 bp, Neisseria gonorrhoeae
atgaaagtaagatggcggtacggaattgcgttcccattgatattggcggttgccttgggcagcctgtcggcatggttgggccgtatcagcgaagtcgaaatcgaggaagtcaggctcaatcccgacgaacctcaatacacaatggacggcttggacggaaggcggtttgacgaacagggatacttgaaagaacatttgagcgcgaaaggtgcgaaacagtttcccgaaaacagcgacatccattttgattcgccgcatctcgtgttcttccaagaaggcaggctgttgtacgaagtcggcagcgatgaagccgtttaccataccgaaaacaaacaggttctttttaaaaacaacgttgtgctgaccaaaaccgccgacggcaggcggcaggcgggtaaagtcgaaaccgaaaaactgcacgtcgataccgaatctcaatatgcccaaaccgatacgcctgtcagtttccaatatggcgcgtcgcacggtcaggcgggcggtatgacctacaaccacaaaacaggcatgttgaacttctcatctaaagtgaaagccgcgatttatgatacaaaagatatg

SEQ ID NO: 8294 - protein, 193 aa, Neisseria gonorrhoeae
MKVRWRYGIAFPLILAVALGSLSAWLGRISEVEIEEVRLNPDEPQYTMDGLDGRRFDEQGYLKEHLSAKGAKQFPENSDIHFDSPHLVFFQEGRLLYEVGSDEAVYHTENKQVLFKNNVVLTKTADGRRQAGKVETEKLHVDTESQYAQTDTPVSFQYGASHGQAGGMTYNHKTGMLNFSSKVKAAIYDTKDM

SEQ ID NO: 8295 - DNA, 171 bp, Neisseria gonorrhoeae
ttgttctttgtttggaagggaaatggctggagaaagacctgcgctatatcggggaatgaatcgatgcaaaggaaatgccgtctgaacatgcgttcgggcagcgtttttataacaaaaacacttaatggcggttggttttatacctatctaagtttttgtgtcgtgcatatc

SEQ ID NO: 8296 - protein, 57 aa, Neisseria gonorrhoeae
LFFVWKGNGWRKTCAISGNESMQRKCRLNMRSGSVFITKTLNGGWFYTYLSFCVVHI

SEQ ID NO: 8297 - DNA, 618 bp, Neisseria gonorrhoeae
gtggttgtaggtcataccgcccgcctgaccgtgcgacgcgccatattggaaactgacaggcgtatcggtttgggcatattgagattcggtatcgacgtgcagtttttcggtttcgactttacccgcctgccgcctgccgtcggcggttttggtcagcacaacgttgtttttaaaaagaacctgtttgttttcggtatggtaaacggcttcatcgctgccgacttcgtacaacagcctgccttcttggaagaacacgagatgcggcgaatcaaaatggatgtcgctgttttcgggaaactgtttcgcacctttcgcgctcaaatgttctttcaagtatccctgttcgtcaaaccgccttccgtccaagccgtccattgtgtattgaggttcgtcgggattgagcctgacttcctcgatttcgacttcgctgatacggcccaaccatgccgacaggctgcccaaggcaaccgccaatatcaatgggaacgcaattccgtaccgccatcttactttcatttgatgtacccgttcaaagccgcgcccaacgtacctttcgcgcggataatcaggtcacacacttcgcgcaccgcgcccgcaccgccggggcgtttggcaata

SEQ ID NO: 8298 - protein, 206 aa, Neisseria gonorrhoeae
VVVGHTARLTVRRAILETDRRIGLGILRFGIDVQFFGFDFTRLPPAVGGFGQHNVVFKKNLFVFGMVNGFIAADFVQQPAFLEEHEMRRIKMDVAVFGKLFRTFRAQMFFQVSLFVKPPSVQAVHCVLRFVGIEPDFLDFDFADTAQPCRQAAQGNRQYQWERNSVPPSYFHLMYPFKAAPNVPFARIIRSHTSRTAPAPPGRLAI

SEQ ID NO: 8299 - DNA, 243 bp, Neisseria gonorrhoeae
atggccttcgccgggcctatgcccggcagcgcctccagctcctgctgcgaagccgcattgatgtttaccgccgcaagggagaaggcgcaggagaacagcatacagaacaatacaaacatttttttcatggtttttcctttaagggttgcaaacaacaaaccgcatcttgcgacgatatggcggattaacaaaaaccggtacggcgttgccccgccccggctcaaagggaacgattccctaagg

SEQ ID NO: 8300 - protein, 81 aa, Neisseria gonorrhoeae
MAFAGPMPGSASSSCCEAALMFTAAREKAQENSIQNNTNIFFMVFPLRVANNKPHLATIWRINKNRYGVAPPRLKGNDSLR

SEQ ID NO: 8301 - DNA, 546 bp, Neisseria gonorrhoeae
atgggaacgcaattccgtaccgccatcttactttcatttgatgtacccgttcaaagccgcgcccaacgtacctttcgcgcggataatcaggtcacacacttcgcgcaccgcgcccgcaccgccggggcgtttggcaatataggcggcgtgttgcagcgtaaaccaatgcgcgtcggggacggcaaccggcaatccgcagcgcaccatcaccggcaaatcgaccacgtcgtcgccgacaaaggcgcactcggcttcttccaagcctgcctgcgcgcgcagctcttcatacgcggcgcgtttgtccgaaatgcctttgaagtagtaatttatgcccaactgtttgacgcggatgccgacggagggcgcgtcccgacctgtgataatcgcagtctgcacgccgcttgcctgaagcattttcaggccgtgtccgtccagtgtgtgaaacgatttgatttcttcgccgtcgtcgcggataaagatgcgcccgtcggtcaaaacgccgtccacatccaatatcagcagtttgattttggcggcgcgtgcctg

SEQ ID NO: 8302 - protein, 182 aa, Neisseria gonorrhoeae
MGTQFRTAILLSFDVPVQSRAQRTFRADNQVTHFAHRARTAGAFGNIGGVLQRKPMRVGDGNRQSAAHHHRQIDHVVADKGALGFFQACLRAQLFIRGAFVRNAFEVVIYAQLFDADADGGRVPTCDNRSLHAACLKHFQAVSVQCVKRFDFFAVVADKDAPVGQNAVHIQYQQFDFGGACL

SEQ ID NO: 8303 - DNA, 417 bp, Neisseria gonorrhoeae; identical to SEQ ID NO: 8197

SEQ ID NO: 8304 - protein, 139 aa, Neisseria gonorrhoeae; identical to SEQ ID NO: 8198

SEQ ID NO: 8305 - DNA, 534 bp, Neisseria gonorrhoeae
atgcaggcaatttctcccgaattacaggcacgcgccgccaaaatcaaactgctgatattggatgtggacggcgttttgaccgacgggcgcatctttatccgcgacgacggcgaagaaatcaaatcgtttcacacactggacggacacggcctgaaaatgcttcaggcaagcggcgtgcagactgcgattatcacaggtcgggacgcgccctccgtcggcatccgcgtcaaacagttgggcataaattactacttcaaaggcatttcggacaaacgcgccgcgtatgaagagctgcgcgcgcaggcaggcttggaagaagccgagtgcgcctttgtcggcgacgacgtggtcgatttgccggtgatggtgcgctgcggattgccggttgccgtccccgacgcgcattggtttacgctgcaacacgccgcctatattgccaaacgccccggcggtgcgggcgcggtgcgcgaagtgtgtgacctgattatccgcgcgaaaggtacgttgggcgcggctttgaacgggtacatcaaa

SEQ ID NO: 8306 - protein, 178 aa, Neisseria gonorrhoeae
MQAISPELQARAAKIKLLILDVDGVLTDGRIFIRDDGEEIKSFHTLDGHGLKMLQASGVQTAIITGRDAPSVGIRVKQLGINYYFKGISDKRAAYEELRAQAGLEEAECAFVGDDVVDLPVMVRCGLPVAVPDAHWFTLQHAAYIAKRPGGAGAVREVCDLIIRAKGTLGAALNGYIK

SEQ ID NO: 8307 - DNA, 180 bp, Neisseria gonorrhoeae; identical to SEQ ID NO: 1039

SEQ ID NO: 8308 - protein, 60 aa, Neisseria gonorrhoeae; identical to SEQ ID NO: 1040

SEQ ID NO: 8309 - DNA, 648 bp, Neisseria gonorrhoeae; identical to SEQ ID NO: 1283

SEQ ID NO: 8310 - protein, 216 aa, Neisseria gonorrhoeae; identical to SEQ ID NO: 1284

SEQ ID NO: 8311 - DNA, 381 bp, Neisseria gonorrhoeae; identical to SEQ ID NO: 1319

SEQ ID NO: 8312 - protein, 127 aa, Neisseria gonorrhoeae; identical to SEQ ID NO: 1320

SEQ ID NO: 8313 - DNA, 408 bp, Neisseria gonorrhoeae; identical to SEQ ID NO: 1333

SEQ ID NO: 8314 - protein, 136 aa, Neisseria gonorrhoeae; identical to SEQ ID NO: 1334

SEQ ID NO: 8315 - DNA, 1053 bp, Neisseria gonorrhoeae
atggatgggcggggtttgaaggcttatgctaccccgattcggaaattttgggtagttttgttacagcaaaggcggatggcaatggcagaaaacgaaaaatatctcgactgggcgcgcgaagtgttgcacaccgaagcggaaggcttgcgcgaaattgcggcggaattggacgaaaacttcgtccttgcggcagacgcgttgttgcactgcaagggcagggtcgtcatcacgggtatgggcaagtccggacatatcgggcgcaaaatggcggcaaccatggcctcgaccggcacgcccgcgtttttcgtccaccctgcggaagcggcacacggcgatttgggcatgattgtggacaacgacgtcgtcgccgccatttccaattccggcgaaagcgacgaaatcaccgccatcatccccgcgctcaaacgcaaagacattaccctcgtctgcatcaccgcccgccccgattcaaccatggcgcgccatgccgatatccacatcaccgcatcggtttcgcaagaagcctgcccgttggggcttgccccgaccaccagcaccaccgccgttatggctttgggcgacgcgttggcggtcgtcctgctgcgcgcccgcgcgttcacgcccgacgacttcgccttgatccaccctgccggcagcctcggcaaacgcctgcttttgcgcgttgccgacattatgcacaaaggcggcggcctgcccgccgtccgactcggcacgcccttgaaaggagccatcgtcagcatgagcgagaaaggtttgggcatgttggcggtaacggacgggcaaggctgtctgaaaggcgtgtttactgacggcgatttgcgccgcctgtttcaagaatgcgacaattttaccggtctttcgatagacgaagtcatgcatacacaccctaaaaccatctccgccgaacgcctcgccaccgaagccctgaaagtcatgcaggcaaaccatgtgaacgggcttctggttaccgatgcagacggcgtgctgacaggtgcgctgaatatgcacgaccttttggcggcgcggattgta

SEQ ID NO: 8316 - protein, 351 aa, Neisseria gonorrhoeae
MDGRGLKAYATPIRKFWVVLLQQRRMAMAENEKYLDWAREVLHTEAEGLREIAAELDENFVLAADALLHCKGRVVITGMGKSGHIGRKMAATMASTGTPAFFVHPAEAAHGDLGMIVDNDVVAAISNSGESDEITAIIPALKRKDITLVCITARPDSTMARHADIHITASVSQEACPLGLAPTTSTTAVMALGDALAVVLLRARAFTPDDFALIHPAGSLGKRLLLRVADIMHKGGGLPAVRLGTPLKGAIVSMSEKGLGMLAVTDGQGCLKGVFTDGDLRRLFQECDNFTGLSIDEVMHTHPKTISAERLATEALKVMQANHVNGLLVTDADGVLTGALNMHDLLAARIV

SEQ ID NO: 8317 - DNA, 93 bp, Neisseria gonorrhoeae; identical to SEQ ID NO: 2131

SEQ ID NO: 8318 - protein, 31 aa, Neisseria gonorrhoeae; identical to SEQ ID NO: 2132

SEQ ID NO: 8319 - DNA, 1053 bp, Neisseria gonorrhoeae
atgactattttatcggacgttaaagcattaggacaacaaatctggctggacaacctttcccgctcgctcgtgcaaagcggcgaattggcgcaaatgctcaaacaaggcgtgtgcggcgtaacttccaatcccgccattttccaaaaagccttcgccggcgacgcgctttatgccgacgaggtcgccgccctcaagcggcaaaacctcagccccaaacaacgctacgaaaccatggcggttgccgacgtacgggcagcctgcgacgtttgccttgccgaacacgaatccaccggcggcaaaaccggtttcgtcagtctcgaagtttctcccgaacttgccaaagacgctcaaggcacggtagaagaagcccgccgcctccatgccgccatcgcgcgtaaaaacgccatgattaaagtgcctgccaccgacgcaggcatcgatgcgctcgaaaccctcgtttcagacggcatcagcgtgaacctgaccctgctgttctcacgcgcccaaaccctcaaagcctacgccgcctacgcgcgcggcattgccaaacgcttggcagccggacaaagcgttgcccatatccaagttgtcgccagcttcttcatctcgcgcgtggacagtgcgctggatgcaacgctgcccgaccggctcaaaggcaaaaccgccatcgcccttgccaaagccgcctatcaagattgggaacaatatttcaccgcccccgaatttgccgcactggaagcccaaggcgcaaaccgcgtgcagcttttatgggcatctaccggcgtgaaaaacccagcctatcccgacacgctctacgttgacagcctgatcggcgtgcacaccgtcaacaccgtccccgatgccacgctcaaagcctttatcgaccacggcacggcgaaagcgacgctgaccgaaagcgcggacgaagcacgggcgcggctcgccgaaattgccgcgctcggcatcgatgtcgaaaccttggcggcgcgtttgcaggaagacggtttgaaacagtttgaagaagcctttgaaaaactgctcgcgcctttggtt

SEQ ID NO: 8320 - protein, 351 aa, Neisseria gonorrhoeae
MTILSDVKALGQQIWLDNLSRSLVQSGELAQMLKQGVCGVTSNPAIFQKAFAGDALYADEVAALKRQNLSPKQRYETMAVADVRAACDVCLAEHESTGGKTGFVSLEVSPELAKDAQGTVEEARRLHAAIARKNAMIKVPATDAGIDALETLVSDGISVNLTLLFSRAQTLKAYAAYARGIAKRLAAGQSVAHIQVVASFFISRVDSALDATLPDRLKGKTAIALAKAAYQDWEQYFTAPEFAALEAQGANRVQLLWASTGVKNPAYPDTLYVDSLIGVHTVNTVPDATLKAFIDHGTAKATLTESADEARARLAEIAALGIDVETLAARLQEDGLKQFEEAFEKLLAPLV

SEQ ID NO: 8321 - DNA, 147 bp, Neisseria gonorrhoeae; identical to SEQ ID NO: 7515

SEQ ID NO: 8322 - protein, 49 aa, Neisseria gonorrhoeae; identical to SEQ ID NO: 7516

SEQ ID NO: 8323 - DNA, 111 bp, Neisseria gonorrhoeae
ttgaaagctgattcaaatagcgggcaattatatcagcaaagccatcagggtacatcttttcagacggcatatgattgcccgaaccgcgcaaactttgacaaaacaggcaaa

SEQ ID NO: 8324 - protein, 37 aa, Neisseria gonorrhoeae
LKADSNSGQLYQQSHQGTSFQTAYDCPNRANFDKTGK

SEQ ID NO: 8325 - DNA, 99 bp, Neisseria gonorrhoeae
gtgattaacctattgatttataatttgtttattattaactgcatttccgatacccccatccatacccccttatatcttagcgtgcccgatgcgccctcg

SEQ ID NO: 8326 - protein, 33 aa, Neisseria gonorrhoeae
VINLLIYNLFIINCISDTPIHTPLYLSVPDAPS

SEQ ID NO: 8327 - DNA, 180 bp, Neisseria gonorrhoeae; identical to SEQ ID NO: 2481

SEQ ID NO: 8328 - protein, 60 aa, Neisseria gonorrhoeae; identical to SEQ ID NO: 2482

SEQ ID NO: 8329 - DNA, 180 bp, Neisseria gonorrhoeae; identical to SEQ ID NO: 2481

SEQ ID NO: 8330 - protein, 60 aa, Neisseria gonorrhoeae; identical to SEQ ID NO: 2482

SEQ ID NO: 8331 - DNA, 132 bp, Neisseria gonorrhoeae
atgccgtctgaaaggctttcagacggcatcgcccttttgaccggacacagtgcggcatatcaaggatccgccctaaaaatattaatgggcaagaagttaatgcacgacattacccgccaacacaaaaggaaa

SEQ ID NO: 8332 - protein, 44 aa, Neisseria gonorrhoeae
MPSERLSDGIALLTGHSAAYQGSALKILMGKKLMHDITRQHKRK

SEQ ID NO: 8333 - DNA, 123 bp, Neisseria gonorrhoeae; identical to SEQ ID NO: 2651

SEQ ID NO: 8334 - protein, 41 aa, Neisseria gonorrhoeae; identical to SEQ ID NO: 2652

SEQ ID NO: 8335 - DNA, 111 bp, Neisseria gonorrhoeae
ttggtagaaatgcaggcaatgagagaattgcagatagagccttcgattttttctcgcctgctcttatggatgattcagctaccgaagagcaatataatgccctatatgatt

SEQ ID NO: 8336 - protein, 37 aa, Neisseria gonorrhoeae
LVEMQAMRELQIEPSIFSRLLLWMIQLPKSNIMPYMI

SEQ ID NO: 8337 - DNA, 243 bp, Neisseria gonorrhoeae; identical to SEQ ID NO: 5667

SEQ ID NO: 8338 - protein, 81 aa, Neisseria gonorrhoeae; identical to SEQ ID NO: 5668

SEQ ID NO: 8339 - DNA, 288 bp, Neisseria gonorrhoeae
atggcaaaagcactcgaaatcatttcacccgatgaaatttattcagatctgatttttaaggatccggtacctccccatactatatatacagaattgatgaaactggttggtagaaatgcaggcaatgagagaattgcagatagagccttcgattttttctcgcctgctcttatggatgattcagctaccgaagagcaatataatgccctatatgatttaaccttgcttgaagagcccgggatggaactggataaagatgagataacggctttgattaatagtcttaaa

SEQ ID NO: 8340 - protein, 96 aa, Neisseria gonorrhoeae
MAKALEIISPDEIYSDLIFKDPVPPHTIYTELMKLVGRNAGNERIADRAFDFFSPALMDDSATEEQYNALYDLTLLEEPGMELDKDEITALINSLK

SEQ ID NO: 8341 - DNA, 414 bp, Neisseria gonorrhoeae
atggtaaagctgacagaacaagatattttgaattggattgggccggaagacgattatatgaatgacgaccatttggcttttttccgcgaattgctggtaaaaatgcaagacgaactcatcgaaaacgcctccgttacaacagggcatctccaagaacacgaatcagcccccgatcctgccgaccgtgccacacaggaagaagagtacgcattggaactccgtacccgggatcgggaacgaaaacttctcagtaaaatacaggcgaccatccgcaatattgatgaaggggactatggattctgtgccgatacgggagaacctatcggcctgaagcggctgctggcacgcccgacagccactttatccgttgaggcccaagaacgccgagagaggatgaagaaacagtttgccgac

SEQ ID NO: 8342 - protein, 138 aa, Neisseria gonorrhoeae
MVKLTEQDILNWIGPEDDYMNDDHLAFFRELLVKMQDELIENASVTTGHLQEHESAPDPADRATQEEEYALELRTRDRERKLLSKIQATIRNIDEGDYGFCADTGEPIGLKRLLARPTATLSVEAQERRERMKKQFAD

SEQ ID NO: 8343 - DNA, 885 bp, Neisseria gonorrhoeae
atgtacacaggacgcttcgcccccagcccgaccgggttgctccacatcggctctctgctgaccgccgtcgcttcctatgccgatgcacgttcaaacggcggcaaatggctggtccgtatggaagacctcgatccgccgcgcgaaatgccgggggcggcaagccatatcctgcacacgctcgaggcattcggattcaagtgggacggcgaagtcacctatcagagccgccgttacgccctgtatgaagaaaccctataccgtctgaaaaccgccggactggtctatccctgccattgcaaccgcaaagactggcaggccggggcaaggcggggcacagacgggttcgtctataacggacgctgccgccaccccggccaacgccctgcactgcaaggcaaacagccgtcgtggcgcatccgcgtccccgaccgcgacatcggcttttcagacggcatcgtcggcagttacgcccaaaacctcgcccgcgacatcggcgatttcgtcctgttccgtgcagacggttactgggcataccagctcgccgtcgttgccgacgatgccgaacagggcgttacccacatcgtgcgcggacaagacctgctcgtttccacaccgcgccaaatctatttgcagcagtgtttgggcgttccgacaccgcaatatgcccacctgccgctgctgaccaacgcgcaagggcagaaatggtcgaagcagacgctcgcccccgcattggatttaaaccgccgcgaacaacttctccgccaagtgttccgctacctcaagctgcccgaagcaccggaaaccgaccgccctgccgaattgctcgactgggcggtggcacactgggatatggacaaagtgccgaaacacgccattaccgccccc

SEQ ID NO: 8344 - protein, 295 aa, Neisseria gonorrhoeae
MYTGRFAPSPTGLLHIGSLLTAVASYADARSNGGKWLVRMEDLDPPREMPGAASHILHTLEAFGFKWDGEVTYQSRRYALYEETLYRLKTAGLVYPCHCNRKDWQAGARRGTDGFVYNGRCRHPGQRPALQGKQPSWRIRVPDRDIGFSDGIVGSYAQNLARDIGDFVLFRADGYWAYQLAVVADDAEQGVTHIVRGQDLLVSTPRQIYLQQCLGVPTPQYAHLPLLTNAQGQKWSKQTLAPALDLNRREQLLRQVFRYLKLPEAPETDRPAELLDWAVAHWDMDKVPKHAITAP

SEQ ID NO: 8345 - DNA, 759 bp, Neisseria gonorrhoeae
atggcggctgccgttgcgggcggattggtcaaacaagggggataccgcatccatatagccaaccgtggtgcggaaaagcgcgaacgtttgggaaaagagttgggggtcgaaacttcggcaaccctgccggagcttcattccgacgatgttttaatccttgccgtcaaaccgcaggatatggaagccgcgtgcaaaaatatccgcaccaacggcgcattggtgctttctgtcgcagccggattgtcggtcggtacgctcagccgttacctcgggggaagccgccgcattgtccgggttatgccgaatacacccggaaaaatcgggctgggcgtatccggtatgtatgccgaagcggaagtatcggaaacagaccgcaggattgccgatcgaatcatgaaatcagtcggtttgaccgtttggttggaagatgaagcgcaaatgcacagcattaccggcatcagcggcagcgggccggcttatgtgttttatctgctggacgcattgcaaaatgccgccatccgacaagggtttgatatggcagaagcacgcgcgctcagtctggcaacgtttaaaggagcggttgcccttgccgagcagacgggtgaagatttcgagaagcttcaaaaaaatgtaacgtcaaaaggcgggacaacccacgaagccgtggaagccttcagacggcatcgtgtcgccgaagccataagtgagggcgtttgtgcctgtgtgtgccgttcgcaggaaatggaacggcaatatcaa

SEQ ID NO: 8346 - protein, 253 aa, Neisseria gonorrhoeae
MAAAVAGGLVKQGGYRIHIANRGAEKRERLGKELGVETSATLPELHSDDVLILAVKPQDMEAACKNIRTNGALVLSVAAGLSVGTLSRYLGGSRRIVRVMPNTPGKIGLGVSGMYAEAEVSETDRRIADRIMKSVGLTVWLEDEAQMHSITGISGSGPAYVFYLLDALQNAAIRQGFDMAEARALSLATFKGAVALAEQTGEDFEKLQKNVTSKGGTTHEAVEAFRRHRVAEAISEGVCACVCRSQEMERQYQ

SEQ ID NO: 8347 - DNA, 405 bp, Neisseria gonorrhoeae
atggaaattcgggtaataaaatatacggcaacggctgcgttgtttgcatttacggttgcaggctgccggctggcggggtggtatgagtgttcgtccttgtccggctggtgtaagccgagaaaacctgccgccatcgatttttgggatattggcggcgagagtccgctgtctttagaggactacgagataccgctttcagacggcaatcgttccgtcagggcaaacgaatatgaatccgcgcaaaaatcttacttttataggaaaatagggaagtttgaagcctgcgggttggattggcgtacgcgtgacggcaaacctttggttgagaggttcaaacaggaaggtttcgactgtttggaaaagcaggggttgcggcgcaacggcctgtccgagcgcgtccgatgg

SEQ ID NO: 8348 - protein, 135 aa, Neisseria gonorrhoeae
MEIRVIKYTATAALFAFTVAGCRLAGWYECSSLSGWCKPRKPAAIDFWDIGGESPLSLEDYEIPLSDGNRSVRANEYESAQKSYFYRKIGKFEACGLDWRTRDGKPLVERFKQEGFDCLEKQGLRRNGLSERVRW

SEQ ID NO: 8349 - DNA, 1044 bp, Neisseria gonorrhoeae
atgtttgagttaaaagaatgtgaaaaccttatgataaacaaggaacttattgaacataaagggaaaaggcgtttatgcgtcgccccgatgctcgactggacggacaggcactaccgttaccttgcccgccagattacccgaaatgcttggctgtacagcgaaatggtcaacgccggcgcgattgtttacggcgacaaagaccgctttttgatgttcaatgaaggcgagcagcccgtcgccctgcaactgggcggcagcgatccgtccgatttggcgaaagccgccaaagccgccgaagaatacggctacaacgaggtcaacctcaactgcggctgtcccagtccgcgcgtgcagaaaggcgcgttcggcgcgtgtctgatgaacgaagtcgggctggttgccgactgcctcaacgccatgcacgacgcggtcggcatccccgttaccgtcaaacaccgcatcggtgtggacaggcagaccgaataccaaaccgttgccgatttcgtcggcacgctgcgcgacaaaaccgcctgcaaaaccttcatcgtccacgcccgcaacgcttggctggacggtctttcgcccaaagaaaaccgcgatgttccgcccttgaaatacgattacgtttaccgcctcaagcaggagtttcccgagctggaaatcatcatcaacggcggcatcaccaccaacgaagcaatcgccggacacttgcaacacgttgacggcgtgatggtcgggcgcgaggcataccacaacccgatggtgatgcgcgaatgggacaggctgttttacggtgacaaccgcgccccgatcgaatacgccgatttggtgcagcgcctctacacatacagccaagtccaaatccaagccggacgcggcacaatcctgcgccacattgtccgccacagcctcgggctgatgcacggtttgaaaggcgcgcggacttggcggcgtatgctttccgatgcaacgctcttgaaagacaacgacggcggcctgattttcgaagcgtggaaagaagtcgaacgggcaaatacgcgcgaa

SEQ ID NO: 8350 - protein, 348 aa, Neisseria gonorrhoeae
MFELKECENLMINKELIEHKGKRRLCVAPMLDWTDRHYRYLARQITRNAWLYSEMVNAGAIVYGDKDRFLMFNEGEQPVALQLGGSDPSDLAKAAKAAEEYGYNEVNLNCGCPSPRVQKGAFGACLMNEVGLVADCLNAMHDAVGIPVTVKHRIGVDRQTEYQTVADFVGTLRDKTACKTFIVHARNAWLDGLSPKENRDVPPLKYDYVYRLKQEFPELEIIINGGITTNEAIAGHLQHVDGVMVGREAYHNPMVMREWDRLFYGDNRAPIEYADLVQRLYTYSQVQIQAGRGTILRHIVRHSLGLMHGLKGARTWRRMLSDATLLKDNDGGLIFEAWKEVERANTRE

SEQ ID NO: 8351 - DNA, 243 bp, Neisseria gonorrhoeae; identical to SEQ ID NO: 5667

SEQ ID NO: 8352 - protein, 81 aa, Neisseria gonorrhoeae; identical to SEQ ID NO: 5668

SEQ ID NO: 8353 - DNA, 156 bp, Neisseria gonorrhoeae
ttgattaaaagaattgataaaacaatgggtttgagtgtgatttgtgccattttggcttctcgtcgcatttcaaaattttgttattatataacattgcattttttatatcataagattttgagaatactcagagggcataggcaaaagtttttcaaa

SEQ ID NO: 8354 - protein, 52 aa, Neisseria gonorrhoeae
LIKRIDKTMGLSVICAILASRRISKFCYYITLHFLYHKILRILRGHRQKFFK

SEQ ID NO: 8355 - DNA, 1161 bp, Neisseria gonorrhoeae; identical to SEQ ID NO: 29

SEQ ID NO: 8356 - protein, 387 aa, Neisseria gonorrhoeae; identical to SEQ ID NO: 30

SEQ ID NO: 8357 - DNA, 684 bp, Neisseria gonorrhoeae
atgacggtgttgcaagaacgttatcgtgaggtgtccgaccgtatcggaaaattggttctgcaggcgggcagggagccgcattccgtcagcctgattgccgtcagcaagaccttcccttcagacggcatccgcgaagtttacgctgccggacagcgtgatttcggcgagaactatattcaggagtggtacggcaaaacggaggaattggcggatttgaccgacatcgtgtggcacgtcatcggcgatgtgcagtccaacaaaaccaaatttgtcgccgaacgcgcgcattgggtgcataccgtatgccgtctgaagaccgccgtccggctgagcaggcagcgtcgctccttaatgccgcccttgcaggtgtgtgtcgaggtgaacattgcgggcgaggcggcaaaacacggtgtcgcgcccgaagaagcggtcgcgcttgccgtggaagtggcgaagctgcccaaccttgtcgtgcgcggactgatgtgcgttgccaaagccaacagcagtgaaacggagttgaaaactcagtttcagaccatgcaaaagctgcttgccgacctcaatgcggctggcgttaaggcggacgtgctgtctatggggatgtcggacgatatgcctgccgccattgagtgcggtgcgacacacgtccgtatcggcagcgcgattttcgggaaaaggggc

SEQ ID NO: 8358 - protein, 228 aa, Neisseria gonorrhoeae
MTVLQERYREVSDRIGKLVLQAGREPHSVSLIAVSKTFPSDGIREVYAAGQRDFGENYIQEWYGKTEELADLTDIVWHVIGDVQSNKTKFVAERAHWVHTVCRLKTAVRLSRQRRSLMPPLQVCVEVNIAGEAAKHGVAPEEAVALAVEVAKLPNLVVRGLMCVAKANSSETELKTQFQTMQKLLADLNAAGVKADVLSMGMSDDMPAAIECGATHVRIGSAIFGKRG

SEQ ID NO: 8359 - DNA, 1041 bp, Neisseria gonorrhoeae; identical to SEQ ID NO: 7579

SEQ ID NO: 8360 - protein, 347 aa, Neisseria gonorrhoeae; identical to SEQ ID NO: 7580

SEQ ID NO: 8361 - DNA, 264 bp, Neisseria gonorrhoeae
atgaacatcagtaaagaacaagggcttttaatcgcatacggcggccgcccgtatatcccgccgagggaagtacacaaagacttttttgcccatatcggctttaacgcgtttaaagcatcgggggtgcggtgcgagcttccgtttccgattttccgattgtccgacagccgaaaatcggaatatttcgtcagcgtccgagagcttgcaaaggcaatcgcagacaaggaggaaaaggcaaaatcggaatatcggaaattccggtct

SEQ ID NO: 8362 - protein, 88 aa, Neisseria gonorrhoeae
MNISKEQGLLIAYGGRPYIPPREVHKDFFAHIGFNAFKASGVRCELPFPIFRLSDSRKSEYFVSVRELAKAIADKEEKAKSEYRKFRS

SEQ ID NO: 8363 - DNA, 288 bp, Neisseria gonorrhoeae
ttgcatcaagaccggaatttccgatattccgattttgccttttcctccttgtctgcgattgcctttgcaagctctcggacgctgacgaaatattccgattttcggctgtcggacaatcggaaaatcggaaacggaagctcgcaccgcacccccgatgctttaaacgcgttaaagccgatatgggcaaaaaagtctttgtgtacttccctcggcgggatatacgggcggccgccgtatgcgattaaaagcccttgttctttactgatgttcatatatacctctttctgt

SEQ ID NO: 8364 - protein, 96 aa, Neisseria gonorrhoeae
LHQDRNFRYSDFAFSSLSAIAFASSRTLTKYSDFRLSDNRKIGNGSSHRTPDALNALKPIWAKKSLCTSLGGIYGRPPYAIKSPCSLLMFIYTSFC

SEQ ID NO: 8365 - DNA, 1224 bp, Neisseria gonorrhoeae; identical to SEQ ID NO: 7591

SEQ ID NO: 8366 - protein, 408 aa, Neisseria gonorrhoeae; identical to SEQ ID NO: 7592

SEQ ID NO: 8367 - DNA, 144 bp, Neisseria gonorrhoeae
ttgaggagtggggttttcatggttttaccggtttattgttatgaagtgaataaagtgtggcacatgaatggggcggataaaatcatgccgtctgaaaacggggatgcggttttcagacggcattgggttttgcggatcaggaaa

SEQ ID NO: 8368 - protein, 48 aa, Neisseria gonorrhoeae
LRSGVFMVLPVYCYEVNKVWHMNGADKIMPSENGDAVFRRHWVLRIRK

SEQ ID NO: 8369 - DNA, 2148 bp, Neisseria gonorrhoeae
atgaaaaccccactcctcaagcctctgctcattacctcgcttcccgttttcgccagtgtctttaccgccgcctccatcgtctggcagctaggcgaacccaagctcgccatgcccttcgtactcggcatcatcgccggcggcctggtcgatttggacaaccgcctgaccggacggctgaaaaacatcatcgccaccgtcgccctgtttaccctctcctcgctcacggcgcaaagcaccctcggcacagggctgcccttcatcctcgccatgaccctgatgaccttcggctttaccattttaggcgcggtcgggctgaaataccgcaccttcgccttcggcgcactcgccgtcgccacctacaccacgcttacctacacccccgaaacctactggctgaccaaccccttcatgattttatgcggcaccgtactgtacagcaccgccatcatcctgttccaaatcatcctgccccaccgccccgtccaagaaagcgtcgccaatgcctacgaagcactcggcggctacctcgaagccaaagccgacttcttcgaccccgatgaggcagcctggataggcaaccgccacatcgacctcgccatgagcaacaccggcgtcatcaccgccttcaaccaatgccgttccgccctgttttaccgtttgcgcggcaaacaccgccacccgcgcaccgccaaaatgctgcgctactacttcgccgcccaagacatccacgaacgcatcagctccgcccacgtcgactaccaagagatgtccgaaaaattcaaaaacaccgacatcatcttccgcatccgccgcctgctcgaaatgcaggggcaggcgtgccgcaacaccgcccaagccatccggtcgggcaaagactacgtttacagcaaacgcctcggacgcgccatcgaaggctgccgccagtcgctgcgcctcctttcagacggcaacgacagtcccgacatccgccacctgagccgccttctcgacaacctcggcagcgtcgaccagcagttccgccaactccgacacagcgactcccccgccgaaaacgaccgcatgggcgacacccgcatcgccgccctcgaaaccggcagcttcaaaaacacctggcaggcaatccgtccgcagctgaacctcgaatcatgcgtattccgccatgccgtccgcctgtccctcgtcgttgccgccgcctgcaccatcgtcgaagccctcaacctcaacctcggctactggatactgctgaccgcccttttcgtctgccaacccaactacaccgccaccaaaagccgcgtgtaccaacgcatcgccggcaccgtactcggcgtaatcgtcggctcgctcgtcccctacttcaccccctccgtcgaaaccaaactctggattgtcatcgccggtaccaccctgttcttcatgacccgcacctacaaatacagtttctccaccttcttcatcaccattcaggcactgaccagcctctccctcgcaggtttggacgtatacgccgccatgcccgtgcgcatcatcgacaccattatcggcgcatcccttgcctgggcggcggtcagctacctgtggccagactggaaatacctcacgctcgaacgcaccgccgcccttgccgtatgcagcagcggcacatacctccaaaaaattgccgaacgcctcaaaaccggcgaaaccggcgacgacatagaataccgcatcacccgccgccgcgcccacgaacacaccgccgccctcagcagcaccctttccgacatgagcagcgaacccgcaaaattcgccgacagcctgcaacccggctttaccctgctcaaaaccggctacgccctgaccggctacatctccgccctcggcgcataccgcagcgaaatgcacgaagaatgcagccccgactttaccgcacagttccaccttgccgccgaacacaccgcccacatcttccaacacctgcccgacatgggacccgacgactttcagacggcattggatacactgcgcggcgaactcggcaccctccgcacccgcagcagcggaacacaaagccacatcctcctccaacagctccaactcatcgcccggcaactcgaaccctactaccgcgcctaccgacaaattccgcacaggcagccccaaaacgcagcc

SEQ ID NO: 8370 - protein, 716 aa, Neisseria gonorrhoeae
MKTPLLKPLLITSLPVFASVFTAASIVWQLGEPKLAMPFVLGIIAGGLVDLDNRLTGRLKNIIATVALFTLSSLTAQSTLGTGLPFILAMTLMTFGFTILGAVGLKYRTFAFGALAVATYTTLTYTPETYWLTNPFMILCGTVLYSTAIILFQIILPHRPVQESVANAYEALGGYLEAKADFFDPDEAAWIGNRHIDLAMSNTGVITAFNQCRSALFYRLRGKHRHPRTAKMLRYYFAAQDIHERISSAHVDYQEMSEKFKNTDIIFRIRRLLEMQGQACRNTAQAIRSGKDYVYSKRLGRAIEGCRQSLRLLSDGNDSPDIRHLSRLLDNLGSVDQQFRQLRHSDSPAENDRMGDTRIAALETGSFKNTWQAIRPQLNLESCVFRHAVRLSLVVAAACTIVEALNLNLGYWILLTALFVCQPNYTATKSRVYQRIAGTVLGVIVGSLVPYFTPSVETKLWIVIAGTTLFFMTRTYKYSFSTFFITIQALTSLSLAGLDVYAAMPVRIIDTIIGASLAWAAVSYLWPDWKYLTLERTAALAVCSSGTYLQKIAERLKTGETGDDIEYRITRRRAHEHTAALSSTLSDMSSEPAKFADSLQPGFTLLKTGYALTGYISALGAYRSEMHEECSPDFTAQFHLAAEHTAHIFQHLPDMGPDDFQTALDTLRGELGTLRTRSSGTQSHILLQQLQLIARQLEPYYRAYRQIPHRQPQNAA

SEQ ID NO: 8371 - DNA, 1242 bp, Neisseria gonorrhoeae; identical to SEQ ID NO: 31

SEQ ID NO: 8372 - protein, 414 aa, Neisseria gonorrhoeae; identical to SEQ ID NO: 32

SEQ ID NO: 8373 - DNA, 1023 bp, Neisseria gonorrhoeae
ttgggcattgagagaacggcatcaaaaaatcgagaaaacaaaatgcaaacagtagcaacaaaaccgacggcaaaacagatgcttgccgccaaacgcgcggcgaaggaatcaacgcggcaggaacgcgccgtcaaacgcgccgggacggtcagaaacgttgaccggaaccggctgtccgcccggtcaaaagcgcaaaaagaaaacatcgcccggatgttgtctggcgcaaaggtatcggaagacgaagccctgacgtgcggcatcatgatgcggctgtccctgcaggatatgcgctatgcctgcaatcaggaattaatcaacttcgccgaacatatcgtcaaacaggtgcaacgcttgggcctgtactgcaacactgacgaccccgcgaacggggaaagcgtactgtttgcctgccgcgaagcatcgcaggccgtcgctcaatggactaaagattttgacaatttaagcccgaatcagcgccaactcgtgctgcgtccgctgtcaaatctcttcgccgcgtacgaagaatttctgaaagacgcgcctgcacggctgatagccgaagtatcggcatactcattggccgtgcgggttgccaagaaagccatggcgtttttagagcttgacggcggtttgatttcggcggttggcaaagtcgtcaacggcgcggattcgcgcgcggaagcccgccgccttaaaatgccgtacgcggaatttacaggccggatcctacacgccgcgaacctgctttacgatgtgggcattcaggcggacaaggagctttcggcgatgtacggcaagccgctgaatcccgtgcgcccccgacggataagcgacgtgcgccggccgatgatgaaaatgcttgttgcggacaaaggcggcgcgttggtccgggccgtaaaagactcggaagacgtcatccggcattgcgacaacggcgccggcttcagctgcttcaactggaccgaacatttcaaacggacggcaaacctgatcagcctcatgcacagggaagcggcggca

SEQ ID NO: 8374 - protein, 341 aa, Neisseria gonorrhoeae
LGIERTASKNRENKMQTVATKPTAKQMLAAKRAAKESTRQERAVKRAGTVRNVDRNRLSARSKAQKENIARMLSGAKVSEDEALTCGIMMRLSLQDMRYACNQELINFAEHIVKQVQRLGLYCNTDDPANGESVLFACREASQAVAQWTKDFDNLSPNQRQLVLRPLSNLFAAYEEFLKDAPARLIAEVSAYSLAVRVAKKAMAFLELDGGLISAVGKVVNGADSRAEARRLKMPYAEFTGRILHAANLLYDVGIQADKELSAMYGKPLNPVRPRRISDVRRPMMKMLVADKGGALVRAVKDSEDVIRHCDNGAGFSCFNWTEHFKRTANLISLMHREAAA

SEQ ID NO: 8375 - DNA, 2184 bp, Neisseria gonorrhoeae
gtgggcttggaaacggtcagcgtcgtcggcaaaagccgtccgcgcgcgacttcggggctgctgcacacttcgaccgcctccgacaaaatcatctccggcgatactttgcgccaaaaagccgtcaacttgggcgacgctttggacggcgtaccgggcatccacgcttcgcaatacggcggcggcgcatccgctcccgttattcgcggtcaaacgggcagacggattaaagtattgaaccatcacggcgaaacgggcgatatggcggacttttctcccgatcacgccattatggtagataccgccttgtcgcaacaggttgaaatcctgcgcgggccggttacgctcttgtacagctcgggcaatgtggcggggctggtcgatgttgccgatggaaaaatccccgaaaaaatgcctgaaaacggcgtatcgggcgaagccggattgcgtttgagcagcggcaatttagaaaaactgacatccgcaggcatcaatatcggactgggcaaaaacttcgtgctgcataccgaaggcttgtaccgcaaatcgggcgattacgccgtaccgcgttaccgcaatctgaaacgcctgcccgacagccatgccgattcgcaaacgggcagcatcgggctgtcttgggtgggcgaaaaaggctttatcggcgcagcatacagcgaccgtcgcgaccgctacggcctgcctgcccacagccacgaatacgatgattgccacgccgacatcatctggcaaaagagtttgatcaacaaacgctatttgcagctttatccgcacttgttgaccgaagaagacatcgattacgacaatccgggcttgagctgcggcttccacgacggcgacggtgcacacgcacacacccacaacggcaaaccgtggatagacctgcgcaacaaacgctacgaactccgcgccgaatggaagcagccattccccggttttgaagccctgcgcgtacatctgaaccgcaatgactaccaccacgacgaaaaagcaggcgatgcagtagaaaacttcttcaacaacaaaacacacaacgcccgtatcgagttgcgccaccaacccataggccgtctgaaaggcagctggggcgtgcaatatttgggacaaaaatccagcgcgctttccgccattcccgaaaccgtccaacaaccgatgttgattgacaacaatgtccgccattacagctttttcggtgtagaacaggcaaattgggacaacttcacgcttgaaggcggcgtacgcgtggaaaaacaaaaagcctccatccggtacgacaaagcattgattgatcgagaaaactactacaaccagcccctgcccgacctcggcgcgcaccgccaaaccgcccgctcgttcgcactttcgggcaactggtatttcacgccacaccacaaactcagcctgaccgcctcccatcaggaacgcctgccgtcaacgcaagaactgtacgcacacggcaagcacgtcgccaccaacacctttgaagtcggcaacaaacacctcaacaaagagcgttccaacaatatcgaactcgcgctgggctacgaaggcgaccgctggcaatacaatctggcagcctaccgcaaccgattcggcaactacatttacgcccaaaccttaaacgacggacgcggccccaaatccatcgaagacgacagcgaaatgaagctcgtgcgctacaaccaatccggtgccgacttctacggcgcggaaggcgaaatctacttcaaaccgacaccgcgctaccgcatcggtgtttccggcgactatgtacgaggccgtctgaaaaacctgccgtccctacccggcagggaagatccctacggcaaacgtcccttcatcgcacaagccgaccaaaacgccccccgcattccggctgcgcgcctcggcttccacctgaaaacctcgctaaccgaccgtatcgatgccaatttggactactaccgcgtgttcgcccaaaacaaactcgcccgctacgaaacgcgtacgcccggacaccatatgctcaacctcggtgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtaaacgtgaagttt

SEQ ID NO: 8376 - protein, 728 aa, Neisseria gonorrhoeae
VGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGEAGLRLSSGNLEKLTSAGINIGLGKNFVLHTEGLYRKSGDYAVPRYRNLKRLPDSHADSQTGSIGLSWVGEKGFIGAAYSDRRDRYGLPAHSHEYDDCHADIIWQKSLINKRYLQLYPHLLTEEDIDYDNPGLSCGFHDGDGAHAHTHNGKPWIDLRNKRYELRAEWKQPFPGFEALRVHLNRNDYHHDEKAGDAVENFFNNKTHNARIELRHQPIGRLKGSWGVQYLGQKSSALSAIPETVQQPMLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYEGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 8377 - DNA, 186 bp, Neisseria gonorrhoeae
cgtttccgtcaaacggcagataccgcttgaaagctgattcaaatagcgggcaattatatcagcaaagccatcagggtacatcttttcagacggcatatgattgcccgaaccgcgcaaactttgacaaaacaggcaaataacaatacaatgcccaatttcgcacaatggtgtgcggatattaaccat

SEQ ID NO: 8378 - protein, 9 aa, Neisseria gonorrhoeae
RFRQTADTA

SEQ ID NO: 8379 - DNA, 132 bp, Neisseria gonorrhoeae
atgccgtctgaagccccgagtttcaggcggcatattcacaaaggcgcatcagccggaggagaagaggaggggggggttgttggaggcggcgcagcgtttggcggagataaaaaaccttatccgacagcgaca

SEQ ID NO: 8380 - protein, 44 aa, Neisseria gonorrhoeae
MPSEAPSFRRHIHKGASAGGEEEGGVVGGGAAFGGDKKPYPTAT

SEQ ID NO: 8381 - DNA, 144 bp, Neisseria gonorrhoeae
atgtcccgtatctacctacccctcctatttccgccccacatcgtcgaacgcggccttttgtattttcagcaggacaaggttcgcgatgtccaaaaaatttccttagggcgttatcgggcgaaggtattcgattcggaaaactat

SEQ ID NO: 8382 - protein, 48 aa, Neisseria gonorrhoeae
MSRIYLPLLFPPHIVERGLLYFQQDKVRDVQKISLGRYRAKVFDSENY

SEQ ID NO: 8383 - DNA, 1014 bp, Neisseria gonorrhoeae
ttgttcgatgatgacgatttcatacgcgcggcttccgccaagatggaggaaattttcggattcggaatcattgaaaaagccaagcattcgggcgggcgtttctatgaaggctgctggctgatgggaacggaaaatgcccaatacgggcgcgtccattacggcggccaacgtgaaacgatgttggttgaattgacggcggtaggctgcaatgctgcaaatattggatgggaatcaaggctttttgattttctgacaaatgcgattcgtccaaaaataacgcgcgttgacattgcaaaagactttttcaacggagagtacagcccgaatcaggcaagagaagaccgcaataaaggtttgtttacgtgccatcacgtcaaaccgaagggcgagtgtcttggttctgattgggaggaagaagacgaagccaaaatgacgagcggcaaaacctacggcataggttcgcgtgagtcttcaaaatatgtacgaatctatgaaaaaggcaagcagcttggcgataaaacaagcacatggacgcgctttgaaatcgaattcaaagcgaaagacattgtaattccctttgaagtcttacagacaccgggcgagtatttcggcggagcatacccgatttgcgaacggtttacaggcagtgcaaaccgtattgaagcggtcaaaagcaagatcatgattgatttcgatacctatatagaacgactgaaaaagcaaatcggacgaggaatcaatgcatcgaaagcagtgtttccggacaaatccaaacaagaattgtttgaagtgcttgagccgaaacatgattttttgcctaaaaaactgagcttcgagaattacgattgcagcgaggcaaagctaacgccactgcatgaaattccgtccgttctaaaatttgaccaatacggcatgtggatggatcgatatattcagcgtcaaaaaagaggggaagagcagcgttatttagagaagatgtatgacaaatacgcaaatttaccgatttcatgggct

SEQ ID NO: 8384 - protein, 338 aa, Neisseria gonorrhoeae
LFDDDDFIRAASAKMEEIFGFGIIEKAKHSGGRFYEGCWLMGTENAQYGRVHYGGQRETMLVELTAVGCNAANIGWESRLFDFLTNAIRPKITRVDIAKDFFNGEYSPNQAREDRNKGLFTCHHVKPKGECLGSDWEEEDEAKMTSGKTYGIGSRESSKYVRIYEKGKQLGDKTSTWTRFEIEFKAKDIVIPFEVLQTPGEYFGGAYPICERFTGSANRIEAVKSKIMIDFDTYIERLKKQIGRGINASKAVFPDKSKQELFEVLEPKHDFLPKKLSFENYDCSEAKLTPLHEIPSVLKFDQYGMWMDRYIQRQKRGEEQRYLEKMYDKYANLPISWA

SEQ ID NO: 8385 - DNA, 213 bp, Neisseria gonorrhoeae; identical to SEQ ID NO: 3559

SEQ ID NO: 8386 - protein, 71 aa, Neisseria gonorrhoeae; identical to SEQ ID NO: 3560

SEQ ID NO: 8387 - DNA, 282 bp, Neisseria gonorrhoeae
atgcagcctgcggtttatattttagcaagccaacgtaatggcacgttatacattggcgttacatctgatttggtgcaacgtatttaccaacatagggagcatttgattgaaggatttacatcacggtacaacgttactatgccggtttggtatgaactgcatcctacgatggagagcgcaattactcgggaaaaacagttgaagaaatggaacagggcttggaaattgcaactgattgaagaaaataatgtttcttggcgggatttatggtttgatattatt

SEQ ID NO: 8388 - protein, 94 aa, Neisseria gonorrhoeae
MQPAVYILASQRNGTLYIGVTSDLVQRIYQHREHLIEGFTSRYNVTMPVWYELHPTMESAITREKQLKKWNRAWKLQLIEENNVSWRDLWFDII

SEQ ID NO: 8389 - DNA, 237 bp, Neisseria gonorrhoeae; identical to SEQ ID NO: 7623

SEQ ID NO: 8390 - protein, 79 aa, Neisseria gonorrhoeae; identical to SEQ ID NO: 7624

SEQ ID NO: 8391 - DNA, 150 bp, Neisseria gonorrhoeae
ttggttttctgtttttgtaggaatgatgaaattttgagttttaggaatttatcggaaaaaacagaaaccgctccgccgtcattcccgctcaggcgggaatccgggtctgtcggtgcggaaacttatcgggtaaaaaggtttctcaggtcc

SEQ ID NO: 8392 - protein, 50 aa, Neisseria gonorrhoeae
LVFCFCRNDEILSFRNLSEKTETAPPSFPLRRESGSVGAETYRVKRFLRS

SEQ ID NO: 8393 - DNA, 165 bp, Neisseria gonorrhoeae; identical to SEQ ID NO: 7631

SEQ ID NO: 8394 - protein, 55 aa, Neisseria gonorrhoeae; identical to SEQ ID NO: 7632

SEQ ID NO: 8395 - DNA, 489 bp, Neisseria gonorrhoeae; identical to SEQ ID NO: 51

SEQ ID NO: 8396 - protein, 163 aa, Neisseria gonorrhoeae; identical to SEQ ID NO: 52

SEQ ID NO: 8397 - DNA, 222 bp, Neisseria gonorrhoeae; identical to SEQ ID NO: 3563

SEQ ID NO: 8398 - protein, 74 aa, Neisseria gonorrhoeae; identical to SEQ ID NO: 3564

SEQ ID NO: 8399 - DNA, 3018 bp, Neisseria gonorrhoeae
atgaacgcgcaaaatctgcccgaggtaaagtgggggcagtcatattcatcagcgccaaaaaaagacagggagcgccaatttacccatacaaataattttaaaatcagaagaaacacaactatatcattcgataataccgataacgttgttgctcaaaaaggcggtatcgtcgttttcggggcggcgacctacctgccgccctacggcaaggtttccggttttgataccgatagtctgaaagggcgcggcaatgccgttgattggattagtacgacccgcccggggttggtaggctacagctacgaaaatgtcacatgccacaacaactacttcgcccccagcagaggctgccctgaagttgtctataaaacccaatttaccttcggtcaacaagggttgcaaagaaaggcaggcaacaagctggatatatacgaagacaaaagccgcgacaattcgcccatttataaattgtcggattatccttggttgggcgtgtctttcaatttgagcagcgagagcttagtcaaagaaaaaagacacaataaaaagatattttattttaacgaggatgtgacgcagcaaaatagtgggaacccccaatacaaagaccaaaacctcgtttatacgacaggcgacggtaataaatattcttcccgttatgtcgggcagaacgaacactccgccatcgccttttatctgaacgccaaactgcacctgctggataaaacccaaatcaaagatatcacgcaaggcaaaacagttgatttgggtaccttgaaaccgcgcatcgaactgtcgaaaggatggaaaaacaggctggatagattttttctaggtaattggacgcttgaagataaaggaaaagtcagcgtcaatctaggcctgccgcaagtcaaagcaggccgctgcatcaacaaaccgaaccccaataataataccaaagccccttcgccggcactgaccgcccccgcgctgtggttcggccctgtgcaaaatggcaaggtgcagatgtattccgcttcggtttctacctaccccgacagttcgagcagccgcatctaccttcaaaatctgaaaagaaaaactgaatccggcaaacccggccgctattccctcgtaaccttgaatgagaatgatattaaaagtaaagagccgagtttcatggggcgggaaacaatcatccgattggatagcggcgtacagctgatcaaactgaatagaaacaaggatgaggtcgtcacttttggaaacaccggcaacaacggcactttcggcattgttaaggaagcgaacgtcaatcttaaagccgacgagtggaaaaaagtgctgctgccttggacggttcgtgctgctgccgatgacggtcgatttaaatcaattaaccgagaatcagacaaatacagccaaagataccgcatccgcgaaaacggcaatcgcgatttgggcgacatcgtcaacagcccgattgtcgcggtcggcgggtatttggcaaccgccgcgaacgacgggatggtgcatatcttcaaaaaaaacggcggcagtgatgaacgcagctacaatctgaagctcagctacatccccggcacgatgccgcgcaaggatattgaaagcaacgattctacactcgccaaagagctgcgcgcctttgccgaaaaaggctatgtgggcgaccgctacggcgtggacggcggctttgtcttgcgccgcattacagatgaccaagacaagcaaaaacatttctttatgtttggtgcgatgggttttggcggcagaggcgcgtatgccttggatttaagcaaaatcgacggaaattatccagccgccgctcccctgtttgatgtcaaaaatggcgataataacggcaaaaatcgcgtgaaagtggaattaggctacaccgtcggcacgccgcaaatcggcaaaacccaaaacggcaaatacgccgccttcctcgcttccggttatgcggctaaaaatattggcagcggcgataataaaaccgcgctgtatgtatatgatttggaaaacggcagtggtagtctgattaaaaaaatcgaagtgcagggcggcaagggcgggctttcgtcccccacgctggtggataaagatttggacggcacggtcgatatcgcctatgccggcgaccggggcggcaatatgtaccgctttgatttgagcgattccaatcctgataaatggtctgtaaggactattttcgaaggcgacaagccgattacttccgcgcccgccgtttcccgactggcagacaaacgcgtcgtcatcttcggtacgggcagcgatttgaccgaagatgatgtactgaatacgggcgaacaatatatttacggtatctttgacgacgataaggggacggttaaggtaacggtacaaaacggcacgggaggcgggttgctcgagcaagtgcttaaagaggaaaataaaacattattcctgaacaagggatccgacggatcgggcagtaaggggtgggtagtgaagctgaaggaaggacaacgcgttaccgtcaaaccgaccgtggtattgcgtaccgcctttgtcaccatccgcagctatacgggtaatgacaaatgcggcgcacaaaccgccattttgggcatcaataccgccgacggcggcgcattgactccgagaagcgcgcgcccgattgtgccggataaccaggttgcgcaatattccggccatcagaaaatgaacggcaagtccatccccataggctgcatgtggaaaaacggcaaaaccgtctgcccgaacggatatgtttacgacaaaccggttaatgtgcgttacctggacgaaaagaaaacagacgatttccccgtcacggcagacggtgatgcaggcggcagcggaacattcaaagagggtaaaaaacccgcccgcaataaccggtgcttctccggaaaaggtgtgcgcaccctgctgatgaacgatttggacagcttggatattaccggcccgatgtgcggtatcaaacgcttaagctggcgcgaagtcttcttc

SEQ ID NO: 8400 - protein, 1006 aa, Neisseria gonorrhoeae
MNAQNLPEVKWGQSYSSAPKKDRERQFTHTNNFKIRRNTTISFDNTDNVVAQKGGIVVFGAATYLPPYGKVSGFDTDSLKGRGNAVDWISTTRPGLVGYSYENVTCHNNYFAPSRGCPEVVYKTQFTFGQQGLQRKAGNKLDIYEDKSRDNSPIYKLSDYPWLGVSFNLSSESLVKEKRHNKKIFYFNEDVTQQNSGNPQYKDQNLVYTTGDGNKYSSRYVGQNEHSAIAFYLNAKLHLLDKTQIKDITQGKTVDLGTLKPRIELSKGWKNRLDRFFLGNWTLEDKGKVSVNLGLPQVKAGRCINKPNPNNNTKAPSPALTAPALWFGPVQNGKVQMYSASVSTYPDSSSSRIYLQNLKRKTESGKPGRYSLVTLNENDIKSKEPSFMGRETIIRLDSGVQLIKLNRNKDEVVTFGNTGNNGTFGIVKEANVNLKADEWKKVLLPWTVRAAADDGRFKSINRESDKYSQRYRIRENGNRDLGDIVNSPIVAVGGYLATAANDGMVHIFKKNGGSDERSYNLKLSYIPGTMPRKDIESNDSTLAKELRAFAEKGYVGDRYGVDGGFVLRRITDDQDKQKHFFMFGAMGFGGRGAYALDLSKIDGNYPAAAPLFDVKNGDNNGKNRVKVELGYTVGTPQIGKTQNGKYAAFLASGYAAKNIGSGDNKTALYVYDLENGSGSLIKKIEVQGGKGGLSSPTLVDKDLDGTVDIAYAGDRGGNMYRFDLSDSNPDKWSVRTIFEGDKPITSAPAVSRLADKRVVIFGTGSDLTEDDVLNTGEQYIYGIFDDDKGTVKVTVQNGTGGGLLEQVLKEENKTLFLNKGSDGSGSKGWVVKLKEGQRVTVKPTVVLRTAFVTIRSYTGNDKCGAQTAILGINTADGGALTPRSARPIVPDNQVAQYSGHQKMNGKSIPIGCMWKNGKTVCPNGYVYDKPVNVRYLDEKKTDDFPVTADGDAGGSGTFKEGKKPARNNRCFSGKGVRTLLMNDLDSLDITGPMCGIKRLSWREVFF

SEQ ID NO: 8401 - DNA, 129 bp, Neisseria gonorrhoeae
atgggaaaacatcaatatggcggcataaagcgcggtatggcggaaaacctgccttttcaaagttttattcatattttattccttaagtttgccttcgcgggacggcgcgccgcgaacgccggggttcgg

SEQ ID NO: 8402 - protein, 43 aa, Neisseria gonorrhoeae
MGKHQYGGIKRGMAENLPFQSFIHILFLKFAFAGRRAANAGVR

SEQ ID NO: 8403 - DNA, 678 bp, Neisseria gonorrhoeae
ttgattttaagtgtgaaagacgaaagcaatttcaaaccatgcccggcaggcagccatcacgccacctgcatccgcatcatcgatttgggtacgcagctcgtcgagtaccaaaacgaacaaaagcggcagcacaagattttagtgcagtgggaaatcgaccctgaaggcgatccggaaatgctgatgccggacggcaggccctacctcatcagccgacgatacaccgccagcctgcacagcaaaagccaactggcaacagacctcaaaagctggcgcggaagggactttacaccggaagaacgcgacaacttcgatttgcgcaatattttgggcaagccctgcctgttgagtatcgcccaccaagaaagcagtgacggcaaaaccacctatgccaacattcccgccatcagcaacaagatgaagagctacaccccgaaacatccggacaacgccgtttttgccttcgacctgtcagaccccgattgggcgaattacggcctcctgaacgagaaactgagggagcagattgccaaaagcccggaatatgccgaagccgtaaacggccgccaaccgccggcgccgccgcagaaacaggcccaagcggcggaagggcggccggaacacccccaaggcaatgccgcgcctgccgaagacatcgaggacgacatcccttttaat

SEQ ID NO: 8404 - protein, 226 aa, Neisseria gonorrhoeae
LILSVKDESNFKPCPAGSHHATCIRIIDLGTQLVEYQNEQKRQHKILVQWEIDPEGDPEMLMPDGRPYLISRRYTASLHSKSQLATDLKSWRGRDFTPEERDNFDLRNILGKPCLLSIAHQESSDGKTTYANIPAISNKMKSYTPKHPDNAVFAFDLSDPDWANYGLLNEKLREQIAKSPEYAEAVNGRQPPAPPQKQAQAAEGRPEHPQGNAAPAEDIEDDIPFN

SEQ ID NO: 8405 - DNA, 108 bp, Neisseria gonorrhoeae; identical to SEQ ID NO: 6455

SEQ ID NO: 8406 - protein, 36 aa, Neisseria gonorrhoeae; identical to SEQ ID NO: 6456

SEQ ID NO: 8407 - DNA, 99 bp, Neisseria gonorrhoeae
gtgcaggtttctgtatggatggattcgtcattcccgcgcaggcgggaatctagaccttgggacaacagcaatattcaaaggttatctgcggcggtttgc

SEQ ID NO: 8408 - protein, 33 aa, Neisseria gonorrhoeae
VQVSVWMDSSFPRRRESRPWDNSNIQRLSAAVC

SEQ ID NO: 8409 - DNA, 159 bp, Neisseria gonorrhoeae; identical to SEQ ID NO: 6451

SEQ ID NO: 8410 - protein, 53 aa, Neisseria gonorrhoeae; identical to SEQ ID NO: 6452

SEQ ID NO: 8411 - DNA, 342 bp, Neisseria gonorrhoeae; identical to SEQ ID NO: 4449

SEQ ID NO: 8412 - protein, 114 aa, Neisseria gonorrhoeae; identical to SEQ ID NO: 4450

SEQ ID NO: 8413 - DNA, 1182 bp, Neisseria gonorrhoeae
atgggcaaacatattcttttaggtgtaacgggcagtattgcggcgtataagtcttgcgagttggtgcgactgctgaaaaaacaggggcattcggttacggtggttatgagccgctcggcaactgaatttgtttctccgctgacttttcaggctttgagcggcaatcccgttctgaccgacacgcacggcggcaacggttcaaacggtatggaacatatcaacctgacccggaatgcggatgtttttctgattgcgccggcaagtatgaataccgtggcaaaaatctgtaacggcgtggcagataacctactgaccaatctggcagccgcacggaaatgccctcttgccatcgctcccgcgatgaatgtggaaatgtggctgaatcctgccaaccaacggaatatcgcacaactggtttcagacggcattactgtctatatgccgggcttgggcgaacaggcttgcagagaaaatggtatgggaaggatgccggaacctgccgaattgctggatttgcttccagacttgtggacaccgaaaattttaagggacaagaaaatcttgattaccgcaggtgcgacatttgaagccattgaccctgtcaggggcatcacaaatacctccagcggaaaaatgggcgtagctttggcgcgggcgtgccgtgccgccggtgcggaaatcagcctgattcacggacagcttcaaaccacgctgcctttcggcatatccgatacggttcaagccgtcagtgccgaagatatgcatcgcgcagtacatcgtttgattgaaaaacaagatgcttttatttctgttgccgccgtctcagactataaggttaaaaacaggagtacgcaaaaattcaaaaaagataaaaatgccaaaccgttatccatcgaattggatgagaaccccgatactttggcttctattgcctcattgccgaacccgccgttctgcatcggttttgccgctgaaacggagaatgtaatggcatatgcgcgggaaaaacgtattaagaaaaaaataccggtgatagttgccaatgatgtttcaatcgcgatgggcaagacaaccaaccaaattgttatcatagatgatgatgcggagttgtctttccccgaaacaagtaaagatgaagcggcaatgcggattgttgaaaggcttgccgtatatttgaacaaa

SEQ ID NO: 8414 - protein, 394 aa, Neisseria gonorrhoeae
MGKHILLGVTGSIAAYKSCELVRLLKKQGHSVTVVMSRSATEFVSPLTFQALSGNPVLTDTHGGNGSNGMEHINLTRNADVFLIAPASMNTVAKICNGVADNLLTNLAAARKCPLAIAPAMNVEMWLNPANQRNIAQLVSDGITVYMPGLGEQACRENGMGRMPEPAELLDLLPDLWTPKILRDKKILITAGATFEAIDPVRGITNTSSGKMGVALARACRAAGAEISLIHGQLQTTLPFGISDTVQAVSAEDMHRAVHRLIEKQDAFISVAAVSDYKVKNRSTQKFKKDKNAKPLSIELDENPDTLASIASLPNPPFCIGFAAETENVMAYAREKRIKKKIPVIVANDVSIAMGKTTNQIVIIDDDAELSFPETSKDEAAMRIVERLAVYLNK

SEQ ID NO: 8415 - DNA, 390 bp, Neisseria gonorrhoeae; identical to SEQ ID NO: 7655

SEQ ID NO: 8416 - protein, 130 aa, Neisseria gonorrhoeae; identical to SEQ ID NO: 7656

SEQ ID NO: 8417 - DNA, 459 bp, Neisseria gonorrhoeae
gtgcacccgccggcaaccggcttcttcttccgcattcagatgccgctcttccagccaaatctcggcgctcaattccgcaacctgcgcctgcttttgagccaacgccatacgcattgccgcaatatcggcgggttttccctttgccgtacggcttccgcctcccttggcgaatccgaaggcatagcccgccgccaataccgccgccaataccgcgaacttaaacgcaatattccttgtcttcatttctatttccttaatttaaaaggttttaattgcgcaccgcgtccgctaaggatggtacggaccgtgcgccgtcggggttatttgcggctaaaatctacaaaaaccgccgccgcgcccactccccggctgacggcgcggcattcctatgcccgctatgaatttgccagcctgccgatgttctccgccagcgcgaaccattcccgctcgtctatggcg

SEQ ID NO: 8418 - protein, 153 aa, Neisseria gonorrhoeae
VHPPATGFFFRIQMPLFQPNLGAQFRNLRLLLSQRHTHCRNIGGFSLCRTASASLGESEGIARRQYRRQYRELKRNIPCLHFYFLNLKGFNCAPRPLRMVRTVRRRGYLRLKSTKTAAAPTPRLTARHSYARYEFASLPMFSASANHSRSSMA

SEQ ID NO: 8419 - DNA, 1410 bp, Neisseria gonorrhoeae
atggggcaaaacctgattttgaatatgaacgattgcggatttaaggttgtcgcctacaaccggacaatcggtaaagtggacgaatttttaaacggtgcggcaaaagagacgggcattatcggcgcgtattccctgcaagacttggtcgataagctggcaaaaccgagaaaaatcatgatgatggttcgcgcaggttcggtggttgacgactttgtcgaacaactgcttccgctgttggaagaaggcgacatcattatcgacggcggcaatgccaattaccccgacacgacacggcggacacattaccttgccggaaaagggattttgtttgtcggcgcgggcgtatccggcggcgaagaaggcgcgcggcgcgggccgtccatcatgccgggcggggataagcgcgcttgggaagcggtcaagccgattttccaggcgattgccgccaaaacgccgcagggcgaaccgtgttgcgactgggtcggcaaggatggcgcgggacattttgtcaaaatggtgcacaacggcatcgaatacggcgatatgcagctgatttgcgaagcgtaccagtttatgaaagacggtttggggctgtcctacgacgaaatgcaccgcgtgtttgccgagtggaataaaaccgagctggattcttatctgattgaaatcacagcggcaattttgggctataaggacgaaggcggcgaaccgctggccgagaaaatcctcgatacggcagggcaaaaaggcacgggcaaatggacgggcatcaatgccttggatttgggcattccgctgacgctgatttccgaagccgtattcgcccgctgtgtttcgtcgttcaaagaacagcgcgtgcagaccggcaagctgttcgcccgaaccgccacgcccgtcgaaggcggcaaacaagaatgggtcgaggcgttgaggcaggctttgcttgcctccaaaatcatttcctacgcacaaggctttatgttgatccgcgaagcgggcgaaagttacggctggggtttggactacggcaacactgcgctgctgtggcgcgaaggctgcatcatccgcagcgcgtttttgggcaatatccgcgacgcgtatgaggccaatcccgatttggtgttcttgggtgcggatccgtatttcaaaaatattttggaaaactgcctgccggcatggcgcaaggtggttgccaaggcggtcgaatgcggcatccctatgccctgcatggcttcggcgattacgttcttggacggctatacgaccgaacgcctgcctgccaacctcttgcaggcacagcgcgactacttcggcgcgcacacttacgagcgcaccgacaaaccgcgcggcgaatttttccataccaactggacgggcaagggcggagataccgcttcgacaacctacgatatt

SEQ ID NO: 8420 - protein, 470 aa, Neisseria gonorrhoeae
MGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 8421 - DNA, 1476 bp, Neisseria gonorrhoeae
atgccggggcacttccggagcgtttgtccaaataacgccgtatccatatcggcgcaagcagccacaatacatcataaagccattggaacatctttctatttcctgcaaaacaaatgccgtccgaacggttcggacggcatttcggcaacggaatcaaatatcgtaggttgtcgaagcggtatctccgcccttgcccgtccagttggtatggaaaaattcgccgcgcggtttgtcggtgcgctcgtaagtgtgcgcgccgaagtagtcgcgctgtgcctgcaagaggttggcaggcaggcgttcggtcgtatagccgtccaagaacgtaatcgccgaagccatgcagggcatagggatgccgcattcgaccgccttggcaaccaccttgcgccatgccggcaggcagttttccaaaatatttttgaaatacggatccgcacccaagaacaccaaatcgggattggcctcatacgcgtcgcggatattgcccaaaaacgcgctgcggatgatgcagccttcgcgccacagcagcgcagtgttgccgtagtccaaaccccagccgtaactttcgcccgcttcgcggatcaacataaagccttgtgcgtaggaaatgattttggaggcaagcaaagcctgcctcaacgcctcgacccattcttgtttgccgccttcgacgggcgtggcggttcgggcgaacagcttgccggtctgcacgcgctgttctttgaacgacgaaacacagcgggcgaatacggcttcggaaatcagcgtcagcggaatgcccaaatccaaggcattgatgcccgtccatttgcccgtgcctttttgccctgccgtatcgaggattttctcggccagcggttcgccgccttcgtccttatagcccaaaattgccgctgtgatttcaatcagataagaatccagctcggttttattccactcggcaaacacgcggtgcatttcgtcgtaggacagccccaaaccgtctttcataaactggtacgcttcgcaaatcagctgcatatcgccgtattcgatgccgttgtgcaccattttgacaaaatgtcccgcgccatccttgccgacccagtcgcaacacggttcgccctgcggcgttttggcggcaatcgcctggaaaatcggcttgaccgcttcccaagcgcgcttatccccgcccggcatgatggacggcccgcgccgcgcgccttcttcgccgccggatacgcccgcgccgacaaacaaaatcccttttccggcaaggtaatgtgtccgccgtgtcgtgtcggggtaattggcattgccgccgtcgataatgatgtcgccttcttccaacagcggaagcagttgttcgacaaagtcgtcaaccaccgaacctgcgcgaaccatcatcatgatttttctcggttttgccagcttatcgaccaagtcttgcagggaatacgcgccgataatgcccgtctcttttgccgcaccgtt

SEQ ID NO: 8422 - protein, 492 aa, Neisseria gonorrhoeae
MPGHFRSVCPNNAVSISAQAATIHHKAIGTSFYFLQNKCRPNGSDGISATESNIVGCRSGISALARPVGMEKFAARFVGALVSVRAEVVALCLQEVGRQAFGRIAVQERNRRSHAGHRDAAFDRLGNHLAPCRQAVFQNIFEIRIRTQEHQIGIGLIRVADIAQKRAADDAAFAPQQRSVAVVQTPAVTFARFADQHKALCVGNDFGGKQSLPQRLDPFLFAAFDGRGGSGEQLAGLHALFFERRNTAGEYGFGNQRQRNAQIQGIDARPFARAFLPCRIEDFLGQRFAAFVLIAQNCRCDFNQIRIQLGFIPLGKHAVHFVVGQPQTVFHKLVRFANQLHIAVFDAVVHHFDKMSRAILADPVATRFALRRFGGNRLENRLDRFPSALIPARHDGRPAPRAFFAAGYARADKQNPFSGKVMCPPCRVGVIGIAAVDNDVAFFQQRKQLFDKVVNHRTCANHHHDFSRFCQLIDQVLQGIRADNARLFCRTV

SEQ ID NO: 8423 - DNA, 324 bp, Neisseria gonorrhoeae
gtgcaggattcggttttccgcctcccaaccgtccaaagcctgccgcatatcctcccgcgcgtaatatctttccatcccccaatcggggctgccgtaagccgccgtgccgtaatatttcaccgccttcgtcctttccgtttgagaaaaccgcccgcagcattcactgtttcgccgtgccgttgccccgctttgaagttcgatacttcatcgctttgtgctatccccggcttggcagatatagctttcgggcggtttgttacttacaaaacaatcattgccttatcttttaagccgtcttttttaaccgtaaaagtaaaagcggtg

SEQ ID NO: 8424 - protein, 108 aa, Neisseria gonorrhoeae
VQDSVFRLPTVQSLPHILPRVISFHPPIGAAVSRRAVIFHRLRPFRLRKPPAAFTVSPCRCPALKFDTSSLCAIPGLADIAFGRFVTYKTIIALSFKPSFLTVKVKAV

SEQ ID NO: 8425 - DNA, 1335 bp, Neisseria gonorrhoeae; identical to SEQ ID NO: 7667

SEQ ID NO: 8426 - protein, 445 aa, Neisseria gonorrhoeae; identical to SEQ ID NO: 7668

SEQ ID NO: 8427 - DNA, 198 bp, Neisseria gonorrhoeae
atgaacgaattaatcagcaaaataaaccgggtcggcgcgagggaaaaggacgggcaaagccttttattgaaagtcggcgaaatctgccgcgacgcgggggcaacttttaccacccgaaaaagcgaaagcctcaatcacaccgcttttacttttacggttaaaaaagacggcttaaaagataaggcaatgattgttttg

SEQ ID NO: 8428 - protein, 66 aa, Neisseria gonorrhoeae
MNELISKINRVGAREKDGQSLLLKVGEICRDAGATFTTRKSESLNHTAFTFTVKKDGLKDKAMIVL

SEQ ID NO: 8429 - DNA, 114 bp, Neisseria gonorrhoeae
atgtccgcataccgcttcccgcaccgcctcggcgattctcgcgcccgctccgcgatgttgtgcgataaagccgtccacgcgcgcctgcatctgcattccgcccccctcgccaga

SEQ ID NO: 8430 - protein, 38 aa, Neisseria gonorrhoeae
MSAYRFPHRLGDSRARSAMLCDKAVHARLHLHSAPLAR

SEQ ID NO: 8431 - DNA, 459 bp, Neisseria gonorrhoeae; identical to SEQ ID NO: 7673

SEQ ID NO: 8432 - protein, 153 aa, Neisseria gonorrhoeae; identical to SEQ ID NO: 7674

SEQ ID NO: 8433 - DNA, 102 bp, Neisseria gonorrhoeae
gtgttggcagctatttggaccggatgggatgagcaggcatgcgccttgcctgcattgccacgattgaggcataccgccccctacccgaaagcgcgattgatg

SEQ ID NO: 8434 - protein, 34 aa, Neisseria gonorrhoeae
VLAAIWTGWDEQACALPALPRLRHTAPYPKARLM

SEQ ID NO: 8435 - DNA, 342 bp, Neisseria gonorrhoeae
ttgtttaccatcctagtcaatccgtgtatcctgcccaaccgtggaaataagccgcaggttctttctgtcggcatttcttccgtccgggcaaatatcccatatgataatgcctgcatcatcaggcagggagaacatccttttgtccgacatgacagttatgtccgctaccgtgatgcaaggattgatgccgtcgaacacatagaaaaccgtgtgcatgaaggaatattctccgtaaaaccaccatgtggcgaacaactgttgaagcgtatcattgccggggcttcaacatcacgatatgccggcagggaagttaagcttctgattgaaaaatttgctatagca

SEQ ID NO: 8436 - protein, 114 aa, Neisseria gonorrhoeae
LFTILVNPCILPNRGNKPQVLSVGISSVRANIPYDNACIIRQGEHPFVRHDSYVRYRDARIDAVEHIENRVHEGIFSVKPPCGEQLLKRIIAGASTSRYAGREVKLLIEKFAIA

SEQ ID NO: 8437 - DNA, 891 bp, Neisseria gonorrhoeae
gtgtacccaatgcatcaccagcattttcacaccgataaaacccaacacgaatgccaagccgtatttcaggaagataaagcgttccgccacatccgccagcaggaaatacatcgcccgcaaacccaaaatagcgaaaatattggaagtcagcacgataaacggatcggtggtaacggcaaagacggcggggatactgtccacggcaaaaacgacatcgctcaattcaatcataatcagcaccaaaaacagcggcgtggcgatttttttgccattctcgacggtaaaaaatttctcgccgtgaaacgccgtgccgaccggaacgactttcttgacggcattcagcagcctgctgtttgccaaatcctcttcctcatctccttcgggcttcatcatgtgtataccagtatagagcaggaacgcgccaaacagatacagaatccactcaaactgccgaaccagtgccgcgccgacgaaaatcatgacggtgcgcaataccaatgcgcccaatacgccgtacagcagcacgcggtgctgaaactgcggtgcgactttgaagtagccgaatatcatcaggaacacgaaaatattgtcgactgccaacgatttttccaaaatgtagccggtaaagaattccaatactttttcttttgcggctgccgcgccgtagccgggattgccggcgagttcgaaatacagccagcctgcgaacaggcaggatacggcaacccacaagccgctccatgccaaggtttctttgatgccgactttatggctgccgtttttcttcagcgaaaacatatccaaggcaatcatgaccagcactgccgcaaaaaaaacgccgtaaaacaacggcgacccgatgccgggatattctgtcatggttcaatctcc

SEQ ID NO: 8438 - protein, 297 aa, Neisseria gonorrhoeae
VYPMHHQHFHTDKTQHECQAVFQEDKAFRHIRQQEIHRPQTQNSENIGSQHDKRIGGNGKDGGDTVHGKNDIAQFNHNQHQKQRRGDFFAILDGKKFLAVKRRADRNDFLDGIQQPAVCQILFLISFGLHHVYTSIEQERAKQIQNPLKLPNQCRADENHDGAQYQCAQYAVQQHAVLKLRCDFEVAEYHQEHENIVDCQRFFQNVAGKEFQYFFFCGCRAVAGIAGEFEIQPACEQAGYGNPQAAPCQGFFDADFMAAVFLQRKHIQGNHDQHCRKKNAVKQRRPDAGIFCHGSIS

SEQ ID NO: 8439 - DNA, 972 bp, Neisseria gonorrhoeae
atgacagaatatcccggcatcgggtcgccgttgttttacggcgttttttttgcggcagtgctggtcatgattgccttggatatgttttcgctgaagaaaaacggcagccataaagtcggcatcaaagaaaccttggcatggagcggcttgtgggttgccgtatcctgcctgttcgcaggctggctgtatttcgaactcgccggcaatcccggctacggcgcggcagccgcaaaagaaaaagtattggaattctttaccggctacattttggaaaaatcgttggcagtcgacaatattttcgtgttcctgatgatattcggctacttcaaagtcgcaccgcagtttcagcaccgcgtgctgctgtacggcgtattgggcgcattggtattgcgcaccgtcatgattttcgtcggcgcggcactggttcggcagtttgagtggattctgtatctgtttggcgcgttcctgctctatactggtatacacatgatgaagcccgaaggagatgaggaagaggatttggcaaacagcaggctgctgaatgccgtcaagaaagtcgttccggtcggcacggcgtttcacggcgagaaattttttaccgtcgagaatggcaaaaaaatcgccacgccgctgtttttggtgctgattatgattgaattgagcgatgtcgtttttgccgtggacagtatccccgccgtctttgccgttaccaccgatccgtttatcgtgctgacttccaatattttcgctattttgggtttgcgggcgatgtatttcctgctggcggatgtggcggaacgctttatcttcctgaaatacggcttggcattcgtgttgggttttatcggtgtgaaaatgctggtgatgcattgggtacacatcccgatttccgtttcgctgtcggtcgtgttcggcgcgttgggtgcatcgatactgacctcgttaatttatacgaaaaaacagcctgataaa

SEQ ID NO: 8440 - protein, 324 aa, Neisseria gonorrhoeae
MTEYPGIGSPLFYGVFFAAVLVMIALDMFSLKKNGSHKVGIKETLAWSGLWVAVSCLFAGWLYFELAGNPGYGAAAAKEKVLEFFTGYILEKSLAVDNIFVFLMIFGYFKVAPQFQHRVLLYGVLGALVLRTVMIFVGAALVRQFEWILYLFGAFLLYTGIHMMKPEGDEEEDLANSRLLNAVKKVVPVGTAFHGEKFFTVENGKKIATPLFLVLIMIELSDVVFAVDSIPAVFAVTTDPFIVLTSNIFAILGLRAMYFLLADVAERFIFLKYGLAFVLGFIGVKMLVMHWVHIPISVSLSVVFGALGASILTSLIYTKKQPDK

SEQ ID NO: 8441 - DNA, 645 bp, Neisseria gonorrhoeae; identical to SEQ ID NO: 35

SEQ ID NO: 8442 - protein, 215 aa, Neisseria gonorrhoeae; identical to SEQ ID NO: 36

SEQ ID NO: 8443 - DNA, 210 bp, Neisseria gonorrhoeae
atgcataaagcatcacccgatgaaggttgcagaggcggaattataagggattttcgggaaaaatacggaagccgcaccaaagaatttgacgaaatgccgcgctttccgaacaaggattgtcggaaaacaaaaaaaagccgagttttgaaaactcagcttttttgctttacctggtgggtcgtgagcgattcgaacgctcgaccaacggat

SEQ ID NO: 8444 - protein, 70 aa, Neisseria gonorrhoeae
MHKASPDEGCRGGIIRDFREKYGSRTKEFDEMPRFPNKDCRKTKKSRVLKTQLFCFTWWVVSDSNARPTD

SEQ ID NO: 8445 - DNA, 270 bp, Neisseria gonorrhoeae; identical to SEQ ID NO: 4477

SEQ ID NO: 8446 - protein, 90 aa, Neisseria gonorrhoeae; identical to SEQ ID NO: 4478

SEQ ID NO: 8447 - DNA, 246 bp, Neisseria gonorrhoeae
gtgccatcattcccattttctttgtttcatcattcttgctttcacgccgtcattctcgcaaaagcagaaaaatcaaaagcaaaaacccaagatcccatcattcctgcgcaggcgggaatccaattcattcggtttcagccgtttccgataaattaccgtaacgttaagttcccggattcccattttcgtgaacataacggtgtgaacattagcaaaaattcaaaaaaccaaacttcctcattcgtg

SEQ ID NO: 8448 - protein, 82 aa, Neisseria gonorrhoeae
VPSFPFSLFHHSCFHAVILAKAEKSKAKTQDPIIPAQAGIQFIRFQPFPINYRNVKFPDSHFREHNGVNISKNSKNQTSSFV

SEQ ID NO: 8449 - DNA, 1251 bp, Neisseria gonorrhoeae
gtggacaaactgaaaatctccgcaaacggcccgctcaacggggaaataacggtctcgggcgcgaaaaacgcggcattgccgctgatgtgcgcgggtttgctgacgtcgggtacgttgcgcctgaaaaacgtccctatgctggcagatgtcgcaaccacgcaaaagctgcttcagggcatgggcgcgcgcgttctgaccgacaatatcagcgaatttgaaatcaacggcggtacggtcaacaatacctgcgccccttacgaattggttcggacgatgcgcgcttcgattttggtgcttggcccgacgctggcgcgtttcggcgaggcgcaagtcagcctgccgggcggctgcgccatcggttcgcgccccgtcaatcagcatttgaaaggcttggaagcgatgggggcggaaatcgccatcgaacacggttacgtcaaagccaaaggcaaactcaaaggtgcgcgcgtggcgatggatgtcgttaccgtcggcggtacggaaaacctgctgatggcggcgacgctggcggaaggtacgacggttttggaaaactgcgccatcgagcctgaagtggtcgatttggcggaatgcctggtcaaaatgggcgcgaaaatcagcggcatcggaacatcgaccatgattgtggaaggtgcgggcgagctgtacggctgcgaacacagcgtcgtccccgaccggattgaagcggggacgttcctgtgtgcggtggcgataaccggcggcagggtggttttgcggaatgccgccccgaaaacgatggaagtggtgttggacaaactggtcgaggcaggtgcggtgattgaagcgggcgacgattggatcgccatcgatatgcggcagcgtccgaaggcggtggacatccgcacggtcgtccatcccggcttccccacggatatgcaggcgcagtttatggcattgaatgccgtggcagagggaagctgccgcgtggtggaaacgatttttgaaaaccgctttatgcacgttccggagttgaaccggatgggggcgaacattacaaccgagggcaatacggcatttgtgcagggtgtggaacggctttccggcgcggtcgtcaaggcgacggatttgcgcgcgtccgccagcctcgttatcgccggtttggcggcgcgcggcgaaaccgtggtcgaacggatttaccacttggatcgcggttatgaaaatattgaaaaaaaactcggcagcgtcggtgcgaacatcgagcgcgtatccggc

SEQ ID NO: 8450 - protein, 417 aa, Neisseria gonorrhoeae
VDKLKISANGPLNGEITVSGAKNAALPLMCAGLLTSGTLRLKNVPMLADVATTQKLLQGMGARVLTDNISEFEINGGTVNNTCAPYELVRTMRASILVLGPTLARFGEAQVSLPGGCAIGSRPVNQHLKGLEAMGAEIAIEHGYVKAKGKLKGARVAMDVVTVGGTENLLMAATLAEGTTVLENCAIEPEVVDLAECLVKMGAKISGIGTSTMIVEGAGELYGCEHSVVPDRIEAGTFLCAVAITGGRVVLRNAAPKTMEVVLDKLVEAGAVIEAGDDWIAIDMRQRPKAVDIRTVVHPGFPTDMQAQFMALNAVAEGSCRVVETIFENRFMHVPELNRMGANITTEGNTAFVQGVERLSGAVVKATDLRASASLVIAGLAARGETVVERIYHLDRGYENIEKKLGSVGANIERVSG

SEQ ID NO: 8451 - DNA, 399 bp, Neisseria gonorrhoeae; identical to SEQ ID NO: 37

SEQ ID NO: 8452 - protein, 133 aa, Neisseria gonorrhoeae; identical to SEQ ID NO: 38

SEQ ID NO: 8453 - DNA, 180 bp, Neisseria gonorrhoeae
ttgaatagcctagacgttattgccctactcaaacaagacggttggtataaagttgcacaatccgggagccattcgcaatataagcacccaacaaaaaaaggccgtgtaaccgtgccgcacccgaaaaaagacttgccgacaggtactgtaaaaaatatctataagcaagccggtttgaag

SEQ ID NO: 8454 - protein, 60 aa, Neisseria gonorrhoeae
LNSLDVIALLKQDGWYKVAQSGSHSQYKHPTKKGRVTVPHPKKDLPTGTVKNIYKQAGLK

SEQ ID NO: 8455 - DNA, 102 bp, Neisseria gonorrhoeae
ttgcctgcggctgacagccctcaagaccgcccgcgttatgcgggctttttacacccttccctgcaactactgccgaaagatatttttacacacaaatacaca

SEQ ID NO: 8456 - protein, 34 aa, Neisseria gonorrhoeae
LPAADSPQDRPRYAGFLHPSLQLLPKDIFTHKYT

SEQ ID NO: 8457 - DNA, 1191 bp, Neisseria gonorrhoeae
atggcatttttaaaactgaccgaacaaaacgtgcggggcaaaaccgtcctcatccgcgccgatatgaacgtgccgttcaaaggcggcaaaatcagcgacgacacccgtatccgcgcctcgctcgcgtccgtcaaatactgcttggacaacggcgcgtccgttattgtgatgacccacttgggccgcccgaccgaaggcgagttccaccccgaagacgacgttgcgcccgttgccgcgcacttgggcggcctgttgggcaaagacgtgaaagtattgaacgactggcgcgaaaacaaaccggctttgaacgcgggcgatgtcgtgatgttgcaaaacgtgcgtatcaacaaaggcgagaagaaaaacgatttagaactgggcaaagcctacgccgccttgtgcgacgtgttcgtcaatgatgcgttcggcaccgcacaccgcgcccaagcttcgaccgaagccgttgcccaagccgcgcccgtcgcctgcgccggcgtattgatggcgggcgaactcgacgctttgggcaaagccctgaaacagcccgcgcgtccgatggtggcgattgttgccggcagcaaagtgtccaccaagctgaccatcctcgaatcgttggcggacaaagtcgatcagcttatcgtcggcggcggcatcgccaacacattcctgttggcggaaggcaaagccatcggtaaatcgctggcggaacatgatttggtggaagaatccaaaaaaattatggcgaaaatggcggccaaaggcggttctgtgccgctgccgaccgatgtcgtcgttgccaaagcctttgccgccgatgccgaagcggtggtaaaagacatcgccgacgttgccgaagacgagatgattttggacatcggcccgaaatccgccgccgcgcttgccgatttgcttaaagccgccggtacggtcgtttggaacgggccggtcggcgtgttcgagttcgatcaattcgcaggcggtacgaaagcccttgccgaagccatcgcccaaagcaaagcgttctcgattgcgggcggcggcgacacgctggcggcgattgccaaattcggcgttaccgaacaaatcggctacatctccaccggcggcggcgcgttccttgagttcttggaaggcaaagagctgcctgccgtagccgctttggaaaaaacgcggcgagtaaacggtttgata

SEQ ID NO: 8458 - protein, 397 aa, Neisseria gonorrhoeae
MAFLKLTEQNVRGKTVLIRADMNVPFKGGKISDDTRIRASLASVKYCLDNGASVIVMTHLGRPTEGEFHPEDDVAPVAAHLGGLLGKDVKVLNDWRENKPALNAGDVVMLQNVRINKGEKKNDLELGKAYAALCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDEMILDIGPKSAAALADLLKAAGTVVWNGPVGVFEFDQFAGGTKALAEAIAQSKAFSIAGGGDTLAAIAKFGVTEQIGYISTGGGAFLEFLEGKELPAVAALEKTRRVNGLI

SEQ ID NO: 8459 - DNA, 828 bp, Neisseria gonorrhoeae
ttggagcatctcatgaaccgatatgccatgcgttttgccgtcatacggtttatgccctatgtccaaacgcgcgaatttgccaacatcggcatcatcataacccacccgcaaagcggctgcttcgactttaaaatcgaacatcgctacagcagattgagccgttttttccgccgcttcgatccgcccgcctataaagcggcgacccgtgcctttgaaaaagaattacagcggattagaaacctggcggcacactccgcgcccgatcagatacgcgccatgcccgaccatctgacccgcccgcgcgaagccctgattatggccgcccaaccgggcgtaaccctcgcccccgacagggggcaggaactgaaccgcctgtttgattattttgtcgcccgcagcttcgccaaaaaccaacccgaagcagaacttacccgacaaatacaggcaatgttaaagccgcttcagacggcataccccttcaaagaaagcacaatcggcgacccgtcaggctttcacgcctccatccccttggtgcaaaaggcggaaaacggcgaaatacggaaaatcatcaagcctatctatttcggacggaaagaccctgccgacatctattacaagtctgataagcggattgccggcataaaacggttgcggcgcggcggatacatcgaccgctctgaaatattgtttgcctacgaaccgccggagcgtcccgacaaggcacaagaaaaggcattgcttgacgtatcgggcgacctggaggaacagggcatacagcttgccgataaccgaagcgaaggcaaaatcatcagaaactttgcctgcggc

SEQ ID NO: 8460 - protein, 276 aa, Neisseria gonorrhoeae
LEHLMNRYAMRFAVIRFMPYVQTREFANIGIIITHPQSGCFDFKIEHRYSRLSRFFRRFDPPAYKAATRAFEKELQRIRNLAAHSAPDQIRAMPDHLTRPREALIMAAQPGVTLAPDRGQELNRLFDYFVARSFAKNQPEAELTRQIQAMLKPLQTAYPFKESTIGDPSGFHASIPLVQKAENGEIRKIIKPIYFGRKDPADIYYKSDKRIAGIKRLRRGGYIDRSEILFAYEPPERPDKAQEKALLDVSGDLEEQGIQLADNRSEGKIIRNFACG

SEQ ID NO: 8461 - DNA, 753 bp, Neisseria gonorrhoeae; identical to SEQ ID NO: 41

SEQ ID NO: 8462 - protein, 251 aa, Neisseria gonorrhoeae; identical to SEQ ID NO: 42

SEQ ID NO: 8463 - DNA, 246 bp, Neisseria gonorrhoeae
atgctgacacccgaacaagtcaaggccctgattgcaggcgtggcaaaatgcgaacacatcgaagtagaaggcgacggacaccattttttcgccgtcatcgtttcattagaatttgaaggcaaggcacgcctcgcgcgccaccgcctgattaaagacggactcaaagcccaactggaaagcaacgaactgcacgcactttccatttcggttgccgccactccggcggaatgggctgccaaagcacaa

SEQ ID NO: 8464 - protein, 82 aa, Neisseria gonorrhoeae
MLTPEQVKALIAGVAKCEHIEVEGDGHHFFAVIVSLEFEGKARLARHRLIKDGLKAQLESNELHALSISVAATPAEWAAKAQ

SEQ ID NO: 8465 - DNA, 183 bp, Neisseria gonorrhoeae
atgaagaaaattccgctaaatgagtatgttgagcagcacggacaggcgaaaacagcaaaagaaatcggcgttactcaaggagcaatttcaaaagcattgaggtctgggcgggcaatttttttattttcagacggcaaaagagtgaaggctgaggaagtgcgggctttcccctcgacacgtctg

SEQ ID NO: 8466 - protein, 61 aa, Neisseria gonorrhoeae
MKKIPLNEYVEQHGQAKTAKEIGVTQGAISKALRSGRAIFLFSDGKRVKAEEVRAFPSTRL

SEQ ID NO: 8467 - DNA, 378 bp, Neisseria gonorrhoeae
atgccgtctgaaacgaaatggtttcagacggcatttttgtgtggcggttattgtgctttggcagcccattccgccggagtggcggcaaccgaaatggaaagtgcgtgcagttcgttgctttccagttgggctttgagtccgtctttaatcaggcggtggcgcgcgaggcgtgccttgccttcaaattctaatgaaacgatgacggcgaaaaaatggtgtccgtcgccttctacttcgatgtgttcgcattttgccacgcctgcaatcagggccttgacttgttcgggtgtcagcatagtggggagtccttattggggaaatgcgccattataccggcaaatcgaaattccgtctgaaaacggcttcagacggaatttt

SEQ ID NO: 8468 - protein, 126 aa, Neisseria gonorrhoeae
MPSETKWFQTAFLCGGYCALAAHSAGVAATEMESACSSLLSSWALSPSLIRRWRARRALPSNSNETMTAKKWCPSPSTSMCSHFATPAIRALTCSGVSIVGSPYWGNAPLYRQIEIPSENGFRRNF

SEQ ID NO: 8469 - DNA, 114 bp, Neisseria gonorrhoeae
ttgggttacagacgtgtcgaggggaaagcccgcacttcctcagccttcactcttttgccgtctgaaaataaaaaaattgcccgcccagacctcaatgcttttgaaattgctcct

SEQ ID NO: 8470 - protein, 38 aa, Neisseria gonorrhoeae
LGYRRVEGKARTSSAFTLLPSENKKIARPDLNAFEIAP

SEQ ID NO: 8471 - DNA, 225 bp, Neisseria gonorrhoeae
ttggcggcggctttcagcatcgcctttttaatcagccgtctgtctttcttcgacaggcggtttctgtcctgcttcttcatttttttcctttccggtaaattgcggatgacttccgcttcaattcggttatatcaattaacatctgacccgacgggctttttatttgggttacagacgtgtcgaggggaaagcccgcacttcctcagccttcactcttttgccgtc

SEQ ID NO: 8472 - protein, 75 aa, Neisseria gonorrhoeae
LAAAFSIAFLISRLSFFDRRFLSCFFIFFLSGKLRMTSASIRLYQLTSDPTGFLFGLQTCRGESPHFLSLHSFAV

SEQ ID NO: 8473 - DNA, 297 bp, Neisseria gonorrhoeae
gaagccaaacgcttgggcgttaaagcctacggcaacgagctgattcccgcaggttccatcatcgtacgccaacgcggtaccaaattccacgcaggcgacaacgtaggtatgggcaaagaccacactttgttcgccaaaattgacggttatgtcgaattcaaaaccaaaggcgcgctgaaccgtaaaactgtcagcatccgtccttacaccggttctgaagaataattcaaccgatacctgaagccgcatcttttcacgatgcggctttttacataccccatacccgatttgatacac

SEQ ID NO: 8474 - protein, 74 aa, Neisseria gonorrhoeae
EAKRLGVKAYGNELIPAGSIIVRQRGTKFHAGDNVGMGKDHTLFAKIDGYVEFKTKGALNRKTVSIRPYTGSEE

SEQ ID NO: 8475 - DNA, 2154 bp, Neisseria gonorrhoeae
atgcccgccccccaaccttccgccccttacgaccccctgaccgccgaagcgcgtaccctgcttttccataccgcctcctacctcaagcccgagcaacaggcggagcttgaaaaagctgtcgcctatgcgtttcgcgcccacgacgggcaaacccgcaaaagcggggatccctacatcacgcatccgattgccgttgcgacgcagctcgccctttggcatatggacatacagggtctttgtgcaggcgtgatgcacgacgtattggaagatacgggcgtgacaaaaggggaaatggcggcggtgttcggcaatactgttgccgagatggtggacgggctgtccaaactcgaaaaactcaaatttgaagatcatgcggaacatcaggcggagagtttccgcaaactgattttggcgatgaccaaagatgtgcgcgtcatcgttgtcaaacttgccgaccgcctgcacaatatgcggacgctcggttcgatgcgcccggacaaacgccgccggattgcaagggaaacccttgaaatctacgcacagattgccaaccgcataggtctgaataatgcgtatcgggagcttcaggatttatcgttccaaaacctgcatcccaaccgctacgagactttaaaaaaagcgatggacaagagccggaagaacaggcaggacgttgtcggcaaagttttgcgcgcgttcggccagcggctggtaggcgcgaatatagaggccaaaatcaaaggcagggaaaaaaacctgtacggcatccatcagaaaatgatggcgaaaaagctgcgctttgccgaggttatggatatttacggtttccgcgtcattgtcaacagcattcccgcctgttatgccgcactcggcacattgcacaccctctatcagcccaagcccggacggttcaaagactatatcgccattccgaaaagcaacggttatcaaagtctgcatacgattttggtcggcccctacggcttgccgattgaagttcagatacgcacgcgggaaatggatgccgtggcggaaggcggtattgtcggccattggagctataaatcagattccaaaacggtcgatcaggcagtgctgcacaccaatcaatggttgaaaaacattttagacttgcaggcaagcagcgccaatgccattgagtttctcgaacacgtcaaagtcgatttgtttccgaacgaaatctacatccttactccgaaaggaaaaatcctaactttgcccaaaggggcaacgcctgtcgattttgcttatgcggtgcataccgacattgggcataaaacagttgccgcgcgtgtcaataatgtgatgatgccgctgcgtacgaagctcaaaaccggtgattctgttgaaattatcacatccgaacacgccaaacccaatcccgcgtggttgaatttcgccgtgtccggcagggcgcgcagtgccatacgccaatatattaaaaatcttaaccggcacgatgcggtcgttttgggagagagcctcttacaaaaagccttgtccagtttgctgcccaaagatgtcctgctttcagacggcatcaaagaaaaataccttgccgatctcaacgacaaacagacttcatttgaggaagtgctgtacaacgtcggtatggggcataccctgcctgtttatgtcgccatgcatatcgccgaattggcaggggagcatttcggcagcgaggtcaggctcagttccattaaagttgatggtcaggaaagcgggcatattcattttgcagagtgctgccaccctgttcccggcgattccatccgtttgctgttggttaagggaaaaggcatgattatccatagggatacctgcccgacgttgttgaagtccgatcccgaacagcagctggatgcagactgggaaaatatgaacgggcagaactaccgtgtcgggcttcaagtccaatcggaagacagccacggcctgttggcattaatggcgcaagcgatttccgattccggtgcggacatcgagtcggtcgaaacaccgtctaaatcccagtcgggaacggaaggttttgtcgaattcaaattcttattgaaagtcaagaatttggatcagttgaatcagattattcaaaatctgcacagcatcccatatatccgcaaagtcatcagaagt

SEQ ID NO: 8476 - protein, 718 aa, Neisseria gonorrhoeae
MPAPQPSAPYDPLTAEARTLLFHTASYLKPEQQAELEKAVAYAFRAHDGQTRKSGDPYITHPIAVATQLALWHMDIQGLCAGVMHDVLEDTGVTKGEMAAVFGNTVAEMVDGLSKLEKLKFEDHAEHQAESFRKLILAMTKDVRVIVVKLADRLHNMRTLGSMRPDKRRRIARETLEIYAQIANRIGLNNAYRELQDLSFQNLHPNRYETLKKAMDKSRKNRQDVVGKVLRAFGQRLVGANIEAKIKGREKNLYGIHQKMMAKKLRFAEVMDIYGFRVIVNSIPACYAALGTLHTLYQPKPGRFKDYIAIPKSNGYQSLHTILVGPYGLPIEVQIRTREMDAVAEGGIVGHWSYKSDSKTVDQAVLHTNQWLKNILDLQASSANAIEFLEHVKVDLFPNEIYILTPKGKILTLPKGATPVDFAYAVHTDIGHKTVAARVNNVMMPLRTKLKTGDSVEIITSEHAKPNPAWLNFAVSGRARSAIRQYIKNLNRHDAVVLGESLLQKALSSLLPKDVLLSDGIKEKYLADLNDKQTSFEEVLYNVGMGHTLPVYVAMHIAELAGEHFGSEVRLSSIKVDGQESGHIHFAECCHPVPGDSIRLLLVKGKGMIIHRDTCPTLLKSDPEQQLDADWENMNGQNYRVGLQVQSEDSHGLLALMAQAISDSGADIESVETPSKSQSGTEGFVEFKFLLKVKNLDQLNQIIQNLHSIPYIRKVIRS

SEQ ID NO: 8477 - DNA, 777 bp, Neisseria gonorrhoeae
atgaaccgtctttatccccacccgattatcgcccgtgagggctggccgattatcggcggcggtttggctttgagcctgctggtgtcgatgtgctgcggctggtggtctttgccgttttgggtgtttaccgtatttgcattgcagtttttccgcgaccctgcgcgtgaaattccgcaaaatcctgaagcggtgttgagtccggttgacggccgtatcgtggtggtcgagcgcgcacgcgatccgtatcgtgatgtcgatgctttgaaaatcagtatttttatgaacgtgttcaacgtgcattcgcaaaaatcgcctgccgattgtacggtaacgaaagtggtctataacaaaggcaaattcgtgaatgcggatttggacaaagccagcacggaaaacgaacgcaacgcggttttggcgactacggcttccggtcgtgaaattacttttgttcaagtggccggtctggtggcacgccgtattttgtgttacacccaagcaggtgcgaaactgtcccgcggcgaacgctatggctttatccgcttcggttcgcgcgtggatatgtatctgcctgtcgatgcgcaggcgcaagtggcgattggtgataaagtaaccggcgtaaaaaccgtattggcgcgtttgccgctgactgattctcaagccgatcctgtttcacaagctgcttcggttgaaacagcggcaaacccatctgccgaacagcagcaaatcgaagcggcggcggctaagattcaggcggctgtgcaagatgtgttgaaagat

SEQ ID NO: 8478 - protein, 259 aa, Neisseria gonorrhoeae
MNRLYPHPIIAREGWPIIGGGLALSLLVSMCCGWWSLPFWVFTVFALQFFRDPAREIPQNPEAVLSPVDGRIVVVERARDPYRDVDALKISIFMNVFNVHSQKSPADCTVTKVVYNKGKFVNADLDKASTENERNAVLATTASGREITFVQVAGLVARRILCYTQAGAKLSRGERYGFIRFGSRVDMYLPVDAQAQVAIGDKVTGVKTVLARLPLTDSQADPVSQAASVETAANPSAEQQQIEAAAAKIQAAVQDVLKD

SEQ ID NO: 8479 - DNA, 153 bp, Neisseria gonorrhoeae; identical to SEQ ID NO: 3611

SEQ ID NO: 8480 - protein, 51 aa, Neisseria gonorrhoeae; identical to SEQ ID NO: 3612

SEQ ID NO: 8481 - DNA, 915 bp, Neisseria gonorrhoeae
atgagcatcatccactacttctcgctgcacgtcgaatccgcgcgctccgcactcaaacagcttctgcgccaacccttcggcacactgcttaccctcataatgcttgccgtcgcgatgaccctgccgctgtttatgtatctgggcatccaaagcgggcaaagcgtgttgggcaaactcaacgagtcgccgcaaatcaccgtctatatggaaaccgccgccgcacaaagcgacagcgataccgtacgcagcctgctgacgcgcgataaacggctcgacaacatccgcttcatcggcaaggaagacggtttggcggaattacagtccaacctcgaccaaaatctgatttccatgcttgacggcaaccccctgccggatgtctttatcgttacccccgacccggcaaccacgcccgcccaaatgcaggcaatctaccgggacattaccaagctgcctatggtcgaatccgcgtctatggataccgaatgggtgcaaacgctgtaccaaatcaacgagttcatccgcaaaatcttatggtttctttccctgacgctgggtatggctttcgtccttgtcgcacacaacaccatccgactgcaaatcctcagccgcaaagaagaaatcgaaatcaccaaactcctgggtgcgcccgcgtcgtttatccgccgccccttcctttatcaggctatgtggcagagtatcttctccgccgccgtcagcttagggctttgcggttggctgctctctgccgtgcgccccttggtcgatgccatcttcaaaccctacggcttgaacatcggctggcgtttcttctacgtcggcgaactcgggctggtgttcggcttcgtcatcgcgttgggcgtattcggcgcgtggcttgccaccacacaacacctgctctgcttcaaagccaaaaaa

SEQ ID NO: 8482 - protein, 305 aa, Neisseria gonorrhoeae
MSIIHYFSLHVESARSALKQLLRQPFGTLLTLIMLAVAMTLPLFMYLGIQSGQSVLGKLNESPQITVYMETAAAQSDSDTVRSLLTRDKRLDNIRFIGKEDGLAELQSNLDQNLISMLDGNPLPDVFIVTPDPATTPAQMQAIYRDITKLPMVESASMDTEWVQTLYQINEFIRKILWFLSLTLGMAFVLVAHNTIRLQILSRKEEIEITKLLGAPASFIRRPFLYQAMWQSIFSAAVSLGLCGWLLSAVRPLVDAIFKPYGLNIGWRFFYVGELGLVFGFVIALGVFGAWLATTQHLLCFKAKK

SEQ ID NO: 8483 - DNA, 150 bp, Neisseria gonorrhoeae
gtggaaacccggttgcaacggggtgacggcaaatcggaaagacggctgaccgcccggacagacgggcggccgataaagaaaaacccgcacggggcgggtaatccccctgaattgcagggaagcggttcaggtaacggcgaaaggcgatta

SEQ ID NO: 8484 - protein, 50 aa, Neisseria gonorrhoeae
VETRLQRGDGKSERRLTARTDGRPIKKNPHGAGNPPELQGSGSGNGERRL

SEQ ID NO: 8485 - DNA, 675 bp, Neisseria gonorrhoeae
atgccgcccttccttacaggacctcctatgatccgtttcgaacaagtttccaaaacctatcccggcggttttgaagccctgaaaaacgtcagcttccagatcaacaaaggcgagatgatttttatcgcgggacactccggttcgggcaaatccaccgtcctcaagctgatttcgggcatcaccaagccgagcatgggcaaagtcctgtttaacggacaggacctcggcacattgtccgacaaccaaatcggctttatgcgccaacacatcggcatcgtgttccaagaccacaaaatcctcaacgaccgcaatgtcctgcaaaacgtcatcctgcccctgcggattatcggctatccgccgcgcaaagccgaagaacgcgcccgcatcgccatcgaaaaagtcggcttgaaaggacgagaattggacgatcccgtaaccctctcgggcggtgaacaacaacgcctgtgcatcgcccgcgccgtcgtccaccagcccggcctgctgattgccgacgaaccctccgccaacctcgaccgtgcctacgcgctcgatattatggaattgttcaaaaccttccacgaagcgggaaccaccgtcatcgtcgccgcacatgacgaaaccctgatggcggactacggacaccgcatcctgcgcctctcgaaaggacgactcgca

SEQ ID NO: 8486 - protein, 225 aa, Neisseria gonorrhoeae
MPPFLTGPPMIRFEQVSKTYPGGFEALKNVSFQINKGEMIFIAGHSGSGKSTVLKLISGITKPSMGKVLFNGQDLGTLSDNQIGFMRQHIGIVFQDHKILNDRNVLQNVILPLRIIGYPPRKAEERARIAIEKVGLKGRELDDPVTLSGGEQQRLCIARAVVHQPGLLIADEPSANLDRAYALDIMELFKTFHEAGTTVIVAAHDETLMADYGHRILRLSKGRLA

SEQ ID NO: 8487 - DNA, 186 bp, Neisseria gonorrhoeae
atgccgtccgacttatccttcatacttaccaaagagcttatccgcagcggttctatccgcttaaagggcagtacggccaaaggacaagccggagaattggcggtattcatccgaacacttcatcaaaaacccgaagaatcggagccaaataccgataacgaatatttaatcgggctgctttccaag

SEQ ID NO: 8488 - protein, 62 aa, Neisseria gonorrhoeae
MPSDLSFILTKELIRSGSIRLKGSTAKGQAGELAVFIRTLHQKPEESEPNTDNEYLIGLLSK

SEQ ID NO: 8489 - DNA, 204 bp, Neisseria gonorrhoeae
atgccgttaaacgccggatgccgtctgaagccgcttcagacggcattttcccgcccggccttcggtatccgccaaacttatccactatctaaaaacaggcggaatctttataatcggtactgtcttacctattgttcagacggcatatccctgcggacgcaaccgcccgaaacgatatgccgcccttccttacaggacctccta

SEQ ID NO: 8490 - protein, 68 aa, Neisseria gonorrhoeae
MPLNAGCRLKPLQTAFSRPAFGIRQTYPLSKNRRNLYNRYCLTYCSDGISLRTQPPETICRPSLQDLL

SEQ ID NO: 8491 - DNA, 132 bp, Neisseria gonorrhoeae
gtgacgcagcttgcggcacggataaccgacttggaaggcaggggcttcgtgtttgccaagccgcgcatgaaggcgggcggccgcgggaagcctgttacgcattattcgattgtcaaaaacggagcggaagta

SEQ ID NO: 8492 - protein, 44 aa, Neisseria gonorrhoeae
VTQLAARITDLEGRGFVFAKPRMKAGGRGKPVTHYSIVKNGAEV

SEQ ID NO: 8493 - DNA, 627 bp, Neisseria gonorrhoeae
gtggaaaattttgatttcagacatgacatttccctacttctcgacaatccccttattatcggcttacgcagggttttactcaataccccgcctccaaccgtaccaaacggtttacaatacccgaatcgacatacaaaggacaaaacgatgaaacgcttgaatctcgccgcaatcgcccttgccgccacatttgccgcacataccgcctcggcagacgaactggccggatggaaagacaataccccgcaaaacctgcaatcgctcaaagcccccgtccgcatcgccaacctatgggcgacttggtgcggtccgtgtcgaaaagagatgcccgccatgtccaaatggtacaaagcgcagaaaaaaggcagcgtcgatatggtcggcatcgcgctcgacacatccgacaatatcggcaactttctcaagcagaccccggtcagctacccgatttggcgttacaccggggcgaacagccgaaactttatgaaatcctacggaaacaatgtcggcgtactgccctttaccgtcgtcgaagccccgaaatgcggatacaggcagaccattacaggagaggtgaacgagaaaagcctgaccgaagccgtcaaactcgcccattcaaaatgccgt

SEQ ID NO: 8494 - protein, 209 aa, Neisseria gonorrhoeae
VENFDFRHDISLLLDNPLIIGLRRVLLNTPPPTVPNGLQYPNRHTKDKTMKRLNLAAIALAATFAAHTASADELAGWKDNTPQNLQSLKAPVRIANLWATWCGPCRKEMPAMSKWYKAQKKGSVDMVGIALDTSDNIGNFLKQTPVSYPIWRYTGANSRNFMKSYGNNVGVLPFTVVEAPKCGYRQTITGEVNEKSLTEAVKLAHSKCR

SEQ ID NO: 8495 - DNA, 195 bp, Neisseria gonorrhoeae
ttgtttgcattgcgtttgtttttgattcataatcgcctttcgccgttacctgaaccgcttccctgcaattcagggggattacccgccccgtgcgggtttttctttatcggccgcccgtctgtccgggcggtcagccgtctttccgatttgccgtcaccccgttgcaaccgggtttccacacaacggccgacggag

SEQ ID NO: 8496 - protein, 65 aa, Neisseria gonorrhoeae
LFALRLFLIHNRLSPLPEPLPCNSGGLPAPCGFFFIGRPSVRAVSRLSDLPSPRCNRVSTQRPTE

SEQ ID NO: 8497 - DNA, 549 bp, Neisseria gonorrhoeae; identical to SEQ ID NO: 43

SEQ ID NO: 8498 - protein, 183 aa, Neisseria gonorrhoeae; identical to SEQ ID NO: 44

SEQ ID NO: 8499 - DNA, 492 bp, Neisseria gonorrhoeae
ttgagcggtgaaccatcagattttgacggttccttatatgtagaaccgtcagtagaaccgtcaggatcaaatgcgcgcggcgcgcgcgcccctgccggaccgcaccctgcgaaaccgcaaacggcgcctcccgaaaccgcagcggcggcgaaggcgaaaaaaaccggcaggcacgaaaccgagctttcgctgcttgccgactacggcatcacggggcaggtggcggcggacttcctgcaagtccgcaaggcaaaacggcagccgctgacggaaacggcaatgcgcctgattgccgccgatgcggagaaatgcgggatgacggcgctgcaggcggcggagtacgccatcgccagcggctgggccagcttccgcgccgaatggctgcaaaacaaaactttcggcgggtctggaaaccgcggcggcccgacgcacaaccaaaccgccgccgtgctggatgcgggaagctacggcgatatgccgacgacggatttt

SEQ ID NO: 8500 - protein, 164 aa, Neisseria gonorrhoeae
LSGEPSDFDGSLYVEPSVEPSGSNARGARAPAGPHPAKPQTAPPETAAAAKAKKTGRHETELSLLADYGITGQVAADFLQVRKAKRQPLTETAMRLIAADAEKCGMTALQAAEYAIASGWASFRAEWLQNKTFGGSGNRGGPTHNQTAAVLDAGSYGDMPTTDF

SEQ ID NO: 8501 - DNA, 351 bp, Neisseria gonorrhoeae
atgtctgaaatcaaaattttccacaatccgcgttgcagcaaatcgcgtgccgccgtgtccctattggaagaacgcggcattgctgccgaagcggtcaaatatttggatacgccgcccgacttgtccgaattgaaggatattttcaacaaattgggcttggaatcggcgcgcgggatgatgcgcgtgaaagatgatttgtacaaggaattgggtttggacaaccccgatttggacaatgacgcgctgctgcgtgccatcgccgatcatcccgccctgttggagcgtccgattgttttggcaaacggtaaggcggctgtcggcagaccgttggaaaatatcgaagcggtattg

SEQ ID NO: 8502 - protein, 117 aa, Neisseria gonorrhoeae
MSEIKIFHNPRCSKSRAAVSLLEERGIAAEAVKYLDTPPDLSELKDIFNKLGLESARGMMRVKDDLYKELGLDNPDLDNDALLRAIADHPALLERPIVLANGKAAVGRPLENIEAVL

SEQ ID NO: 8503 - DNA, 777 bp, Neisseria gonorrhoeae; identical to SEQ ID NO: 45

SEQ ID NO: 8504 - protein, 259 aa, Neisseria gonorrhoeae; identical to SEQ ID NO: 46

SEQ ID NO: 8505 - DNA, 1269 bp, Neisseria gonorrhoeae
gtgtccggttgggttttgaaatccgcgtacttgcagaaaaagcaggtttcacgcacggtagctctcccagtcgaacggaatcagcttgccgccgccgtcccgcagcctgtccctgatccgcgcgtcggtgttttcgcggaaggcttccgccgtcaggttggtcagcaccagcatcggcatcagccgctcgtaccgggcgttgacgacggaaaacaaaatccgcccgtccgtttccgacagactgcccgcgccgaactcgtccagcaccagcaaatcgggcttcacgaaaatcccgaccgcccccgcctcgccgccgccgccgaaactgtccttgaccgtccgcagcatatcgcccaccgtgatgaccagcgcgcttttgccggcggcgatgacttcgcgggcgatgccgcaggcaaggtggtttttgcccgtgcccctcctgcccgaaaaaatcatgctccgccccgtctgcaacacatcggcgaagtttgccgcatactcggcggcggccgccttcgccctcgccatccccgggatcgaatcgctgacggcgtagttttcaatccggcagtttctgaaccgcggggcgatgcccgaacgcccgatgcgtttttccagcgcgtcgcgcatcgccccgcggcgcagcgtttccgcgtatgccgccatttcgtccgccgcctccagcttccggcaggccgggcagcccgtccacacgccgcgcaaaacgcttttcgccgcgtatccgccgtgttccgcgcattgcctccgctcgacccgcacgccgccgccgtaagcccccaagaaatcagacgcgttcctcaaagccatatccgaacccccccctcaaaaatccgtcgtcggcatatcgccgtagcttcccgcatccagcacggcggcggtttggttgtgcgtcgggccgccgcggtttccagacccgccgaaagttttgttttgcagccattcggcgcggaagctggcccagccgctggcgatggcgtactccgccgcctgcagcgccgtcatcccgcatttctccgcatcggcggcaatcaggcgcattgccgtttccgtcagcggctgccgttttgccttgcggacttgcaggaagtccgccgccacctgccccgtgatgccgtagtcggcaagcagcgaaagctcggtttcgtgcctgccggtttttttcgccttcgccgccgctgcggtttcgggaggcgccgtttgcggtttcgcagggtgcggtccggcaggggcgcgcgcgccgcgcgcatt

SEQ ID NO: 8506 - protein, 423 aa, Neisseria gonorrhoeae
VSGWVLKSAYLQKKQVSRTVALPVERNQLAAAVPQPVPDPRVGVFAEGFRRQVGQHQHRHQPLVPGVDDGKQNPPVRFRQTARAELVQHQQIGLHENPDRPRLAAAAETVLDRPQHIAHRDDQRAFAGGDDFAGDAAGKVVFARAPPARKNHAPPRLQHIGEVCRILGGGRLRPRHPRDRIADGVVFNPAVSEPRGDARTPDAFFQRVAHRPAAQRFRVCRHFVRRLQLPAGRAARPHAAQNAFRRVSAVFRALPPLDPHAAAVSPQEIRRVPQSHIRTPPSKIRRRHIAVASRIQHGGGLVVRRAAAVSRPAESFVLQPFGAEAGPAAGDGVLRRLQRRHPAFLRIGGNQAHCRFRQRLPFCLADLQEVRRHLPRDAVVGKQRKLGFVPAGFFRLRRRCGFGRRRLRFRRVRSGRGARAARI

SEQ ID NO: 8507 - DNA, 153 bp, Neisseria gonorrhoeae
atgcgcgaaggcgcggaatgcggaagagcgggcgaagcattacccgcgaaccaatccgtgcgccgccggggcgtttcagacggcatcgggggcggcagtcgcaaaaaggacggcggtgcttggggaatatccccccccgcaatgcgccgaatt

SEQ ID NO: 8508 - protein, 51 aa, Neisseria gonorrhoeae
MREGAECGRAGEALPANQSVRRRGVSDGIGGGSRKKDGGAWGISPPAMRRI

SEQ ID NO: 8509 - DNA, 654 bp, Neisseria gonorrhoeae
gtgaacaaacggctgttttgcagccgcaacggcttgcgctattacctgttgggcggtttctgtttgagtgtttttccgcttttgctggtgtttgcctcatccgtttgggcggtttatcggacgggcgggcaggttttgccgccgtatgtccgggcggatgccgcgctggtgttgggcgcagccgcgtgggacaaacgcccttccccggtttttcgggaacgcatcaaccacgccatcgcgctttaccaaagccgcagggtaggcaaaatcgtgtttacgggagggcgaaccaaaaaaggctatatgaccgaagccgaggtcgggcggcggtacgcgctcaaacagggggttccggcgcgcaacatcctgtttgaaaacacttcgcgcaacacttatgaaaacctgaacaacatccgtccggttttgcgtgccaacggtattgccagcgtggtgattgtcagcgatccctaccatttggcgcgggcggcggaaatggcggaggatttgggtgtccgcgtttatatgtctgccacgccgaccacgcggtttgatgcgggaaataagaaaaaaatctttatgctgcaagaggggtatgcgttatccctctaccgtttggaaaaatggggcagccgctttttgggatggctgtctgat

SEQ ID NO: 8510 - protein, 218 aa, Neisseria gonorrhoeae
VNKRLFCSRNGLRYYLLGGFCLSVFPLLLVFASSVWAVYRTGGQVLPPYVRADAALVLGAAAWDKRPSPVFRERINHAIALYQSRRVGKIVFTGGRTKKGYMTEAEVGRRYALKQGVPARNILFENTSRNTYENLNNIRPVLRANGIASVVIVSDPYHLARAAEMAEDLGVRVYMSATPTTRFDAGNKKKIFMLQEGYALSLYRLEKWGSRFLGWLSD

SEQ ID NO: 8511 - DNA, 1353 bp, Neisseria gonorrhoeae; identical to SEQ ID NO: 4507

SEQ ID NO: 8512 - protein, 451 aa, Neisseria gonorrhoeae; identical to SEQ ID NO: 4508

SEQ ID NO: 8513 - DNA, 3021 bp, Neisseria gonorrhoeae
gtggggataaagacggttcatttgtcatccttttattcaaatatattaaatagcgacattataacggaatccgccgcgttccgccgacaaatgccgtctgaacgcggcttcagacggcatccgagaaagtgctacaatatcggttttcctttattttttcaggcggcatccattatgtgcaaccatcatccccgacattcgcacgacaacgacaccatccgcattcgcggcgcgcgcacgcataatttgaaaaacatcgatttggacattccccgccacaagctcgtggtggtaacaggattgtcaggcagcggcaaatcatcgctggcgtttgatactttatatgccgaagggcagcggcgttatgtcgagagcctgtctgcctatgcgcggcagtttttgcagatgatggacaaacccgatgtcgatttgattgaaggcctgtcgcctgcgatttccatcgagcagaaatccaccagccacaatccgcgttccaccgtcggcacggtaacggaaatccacgactacctgcgccttttatacgcccgtgtcggcacgccgtattgccccgaacacaagctgccgctatccagccaaaccgtatctcaaatggtcgatgccgtattaaaactgccggaagatacgcgcgtgatgattctggggccggcggtgcgcgagcgtaagggcgagtttgtcgatttctttgccgacttgcaggcgcaaggctttgcccgtgtgcgcgtggacggcgaagtctatcagcttgacgaagtaccgaagctggaaaaaaacatcaaacacaatatcgacgtcgtcatcgaccgcgtgaaagtgaaagccgacatcaaacaacgactggcggaaagttttgaaaccgcgctgcgccacggcaacgagcgcgcgctggcgatggaaatggacagcggcgaagaacattggttttccgcgcgttttgcctgccccgtgtgttcgtacagcctgcccgaattggaaccgcgcctcttttcgttcaacaacccgatgggttcctgcccgacttgcgacggcttgggcaacaccaatttcttcgaccccgaaaaagtagtcgcccatcccgaattgtcgctggcaaccggcgcgattgacggttgggacaaacgcaaccaattctatttccaaatgattcaatcgctggcgcatcattataaatttgatgtcaacgtcgcttgggaaactttgcctgaaaaagtcaaaaaagtcgtgttgcacggctcgggcaaagaagtcattgatttcacctacctgtccgaacgcggcaccaccttcaaccgcagccacgccttcgagggcatcatccccaatctcgaacgccgctaccgcgaaaccgacagcgaaaccgtgcgcgaaaaactgcgcgagtaccaaaatcaccgtgcctgcccgagctgcggcggcgcacgtttgcgcaaagaagcacgctacgtttacgtcggcggcgaaccgttgcacgaagtctccgcctggccgctgaccaaaacccaccgattcttcgaaacgctggatttggacggcaacaaaaaacagatcgccgaaaaaatcctcaaagaaatcaccgagcggctcggcttcttgattaacgtcgggctggattacctgaatttaagccgttccgccgaaaccctttccggcggcgaagcccagcgcatccgcctcgccagccaaatcggcagcggcctgaccggcgtgatgtacgttttggacgaaccctccatcggcctgcaccagcgcgacaacgaccgcctgctcgccaccctcaaacgcctgcgcgatttgggcaacagcgtaattgtggtcgaacacgacgaagacgccatccgcgaagccgatttcgtcgtcgatatgggccccggcgcgggcgaacacggcggcaacgtactgattgccgacacgcccgaaaatgtcgccaaatgcgaaaaatccgttaccggacaatacctcggcggtaaaaaatccattgccgtgccgtctgaacgcacgcccgtcaatcccggccgaatgctcgtcctcaaaggcgcgcgcggcaacaacctcaaaaacgtaaccctcgagttgccgcttggtttgattacctgcatcaccggcgtatccggcagcggcaaatccaccctgattaacgacaccctcgccaaaatcactgcccgcgaactcaaccgcgcccaagaagagcccgccccatacgacgacatccgcggcctcgaacacctcgacaaagtcatcaacgtcgaccaatcccccatcggccgcaccccgcgctccaaccccgccacctacaccggcctgtttacccccatccgcgaactcttcgccggcgtacccctctcgcgcgaacgcggctacaacgtcggcagattctccttcaacgtcaaaggcggccgctgcgaagcctgccaaggcgacggcgtaatcaaagtcgaaatgcacttcctgcccgacgtgtacgtcccctgcgaagtctgccacggcaaacgctacaaccgtgaaaccctcgaaatccaatacaagggcaaaaacatcagccaagtcctcgacatgacggtcgaagaagcccgcgaatttttcgacgccgtccccaccgtatcgcgcaaactgcaaaccctgatggacgtaggtctcggctacatccgcctcggccagtccgccaccaccctctccggcggcgaagcccagcgcgtcaaactcgccttggaactctccaaacgcgacaccggcagaacgctctacatcctcgacgaacccaccaccggcctgcacttcgccgacatcgccctgctgctggaagtcataggccgtctgaaaggcaaaggcaactcgattgtgattatcgagcataatctggatgtaattaaaaccgcggattggattgtggacttagggccggaaggcggcgatggtgggggtaaggttatcgcgaaaggtagccctgaggaagtggcgaaggttaaggggagttataccgggaagtatttgaaagtggttttgaag

SEQ ID NO: 8514 - protein, 1007 aa, Neisseria gonorrhoeae
VGIKTVHLSSFYSNILNSDIITESAAFRRQMPSERGFRRHPRKCYNIGFPLFFQAASIMCNHHPRHSHDNDTIRIRGARTHNLKNIDLDIPRHKLVVVTGLSGSGKSSLAFDTLYAEGQRRYVESLSAYARQFLQMMDKPDVDLIEGLSPAISIEQKSTSHNPRSTVGTVTEIHDYLRLLYARVGTPYCPEHKLPLSSQTVSQMVDAVLKLPEDTRVMILGPAVRERKGEFVDFFADLQAQGFARVRVDGEVYQLDEVPKLEKNIKHNIDVVIDRVKVKADIKQRLAESFETALRHGNERALAMEMDSGEEHWFSARFACPVCSYSLPELEPRLFSFNNPMGSCPTCDGLGNTNFFDPEKVVAHPELSLATGAIDGWDKRNQFYFQMIQSLAHHYKFDVNVAWETLPEKVKKVVLHGSGKEVIDFTYLSERGTTFNRSHAFEGIIPNLERRYRETDSETVREKLREYQNHRACPSCGGARLRKEARYVYVGGEPLHEVSAWPLTKTHRFFETLDLDGNKKQIAEKILKEITERLGFLINVGLDYLNLSRSAETLSGGEAQRIRLASQIGSGLTGVMYVLDEPSIGLHQRDNDRLLATLKRLRDLGNSVIVVEHDEDAIREADFVVDMGPGAGEHGGNVLIADTPENVAKCEKSVTGQYLGGKKSIAVPSERTPVNPGRMLVLKGARGNNLKNVTLELPLGLITCITGVSGSGKSTLINDTLAKITARELNRAQEEPAPYDDIRGLEHLDKVINVDQSPIGRTPRSNPATYTGLFTPIRELFAGVPLSRERGYNVGRFSFNVKGGRCEACQGDGVIKVEMHFLPDVYVPCEVCHGKRYNRETLEIQYKGKNISQVLDMTVEEAREFFDAVPTVSRKLQTLMDVGLGYIRLGQSATTLSGGEAQRVKLALELSKRDTGRTLYILDEPTTGLHFADIALLLEVIGRLKGKGNSIVIIEHNLDVIKTADWIVDLGPEGGDGGGKVIAKGSPEEVAKVKGSYTGKYLKVVLK

SEQ ID NO: 8515 - DNA, 534 bp, Neisseria gonorrhoeae
ttgaaaaccgcgttaaaacgcaaatttgaaaggaaatacggaatgacagtccgaaacacgcaaaccgaaaccgtccggacggaagccgcgccgcaacaaggcggcaataccaacccgggctattacaaaaaccgcgccttcgagtgcgtcgggtttgcgcaatacctcaacttcaacctcggcaacgccttcaaatacatctggcggcacaaggaaaaaggcgggcgcgaagacttggaaaaagccctgcggtacttggaacgccaacgcgccggcgcgccgaagttcaagaaactcaaacaccgccgctatgaaaaaatgtacgccggtctgaaagattgcgggttcgacggcggcacggaggccgcgctgcttgccgtcatctccgccgcttattacatccgggacggcgaagacaattttgcgtgggcggccgcctgtgtcgaagatttgttggaaaaaatgccgcctgaagcggggcgggccccgcaccctgaaagcccgatgccgcctgaaacggcgggcggaggcatt

SEQ ID NO: 8516 - protein, 178 aa, Neisseria gonorrhoeae
LKTALKRKFERKYGMTVRNTQTETVRTEAAPQQGGNTNPGYYKNRAFECVGFAQYLNFNLGNAFKYIWRHKEKGGREDLEKALRYLERQRAGAPKFKKLKHRRYEKMYAGLKDCGFDGGTEAALLAVISAAYYIRDGEDNFAWAAACVEDLLEKMPPEAGRAPHPESPMPPETAGGGI

SEQ ID NO: 8517 - DNA, 1452 bp, Neisseria gonorrhoeae
  MISC_FEATURE (1)..(1452): n = g, a, t, or c
ttgatgcctaagcacggtaaaaacagtaaaataaacgctttcaaagatttcggagccattatgaccgtcaaaacccgtttcgcccccagccccaccggttacctgcacatcggcggcgttcgcaccgccttgttttcgtgggcgtttgcccgccatcataaaggcgaatttttattgcgtatcgaagacaccgacttggcacgttccaccgccgaatccgtcaacatcatccttgacggcatgaaatgggtcggtctcgattacgacaacgccgacaacgtggtgtaccaaacccgccgtttcgaccgttataaagaagtcattgccgaactcttggcaaaaggcgatgcctactactgctattgcagcaaagaagaattggaagcgatgcgcgagaaagccgaaaaagaaggcacggcgacttacgaccgccgctggcggccggaagcaggcaaaaccctgcccgaaattcctgcaggcgtgcaacccgtcgtccgcttcaaaacgcctttggacggcgttaccaaatggacagacttggtcaaaggcgaaatctccatccccaacgaagccctagacgacctgattattgcccgcgccgacggtacgccgacctacaacttctgcgccgtggtagacgactacgacatgggcgttacccacattatccgcggggacgaccatgtgaacaacaccccgaaacaaatcaacatcttgaaagccatcggcgcgaacctgcccgaatacgggcatctgccgatgattctcaacgaacaaggcaaaaaaatctccaaacgcagcggcgataccgtcgccattaccgatttcggcgcaatgggcattctgcccgaagcgatgctcaactatttggcgcgtttgggctgggcgcacggcgacgatgagtttttcacgacggaacaattcatcgaatggtttgatttgaaagacgtttccccgtccccaagccgtatggatttgaaaaagctctattggatcaacggcgaacacatcaaaatcacacccgacggcaaacttaccgaactcgtcaaaccgcgccttgcgctgcgcgatattcatgaaaccgaaaaacctgcgttggaagacgtgttggcactggtcaaagaccgcgcccaagatttgaacgccttggcagacgaatgcctgtatttctacaaaaaacaagtccctgccgaagccgatgttgccaaacactgggacgacgaagccgccgcccgtatgctgcgcttcgccgaacgcctcgaagggctggaagactggaacgccaaagccattcacgacctcttcaaacctttctgcgacgaagaaggcatcaaaatgggcaaactcggtatgcccctgcgccttgctgtctgcggtacggcaaaaaccccgagcgtcgatgccgtgttggcattaatcagcaaagagnaagtgttgaaacgcatccgtgct

SEQ ID NO: 8518 - protein, 484 aa, Neisseria gonorrhoeae
  MISC_FEATURE (1)..(484): Xaa = any amino acid
LMPKHGKNSKINAFKDFGAIMTVKTRFAPSPTGYLHIGGVRTALFSWAFARHHKGEFLLRIEDTDLARSTAESVNIILDGMKWVGLDYDNADNVVYQTRRFDRYKEVIAELLAKGDAYYCYCSKEELEAMREKAEKEGTATYDRRWRPEAGKTLPEIPAGVQPVVRFKTPLDGVTKWTDLVKGEISIPNEALDDLIIARADGTPTYNFCAVVDDYDMGVTHIIRGDDHVNNTPKQINILKAIGANLPEYGHLPMILNEQGKKISKRSGDTVAITDFGAMGILPEAMLNYLARLGWAHGDDEFFTTEQFIEWFDLKDVSPSPSRMDLKKLYWINGEHIKITPDGKLTELVKPRLALRDIHETEKPALEDVLALVKDRAQDLNALADECLYFYKKQVPAEADVAKHWDDEAAARMLRFAERLEGLEDWNAKAIHDLFKPFCDEEGIKMGKLGMPLRLAVCGTAKTPSVDAVLALISKEXVLKRIRA

SEQ ID NO: 8519 - DNA, 402 bp, Neisseria gonorrhoeae
gtgcgggcaatgccgtctgatgtcggaatgcggcttcagacggcattcagacggaagttgaacatgaaaaaaatattgtattttctgatgtttgttttttctacaagcgtatgggcagggggtgcggaagacaatttgctcagcatccaatccggttaccgtgctttactgcaaaagcaaaacaatctggacggaaaaatcatcgggatgcagtcggatttggaagatgcgcgccggcgtttgcaggcggctcaggcagacatcgcccgtttggaagcggaaattcctgcagcaatggcccaaaaagcccggcaggctgaagagatgaggcaaatcggagtgcgtttggaccatgcttggaatgcggtttacggcgcaggggaacgaaagcgtcgggggaat

SEQ ID NO: 8520 - protein, 134 aa, Neisseria gonorrhoeae
VRAMPSDVGMRLQTAFRRKLNMKKILYFLMFVFSTSVWAGGAEDNLLSIQSGYRALLQKQNNLDGKIIGMQSDLEDARRRLQAAQADIARLEAEIPAAMAQKARQAEEMRQIGVRLDHAWNAVYGAGERKRRGN

SEQ ID NO: 8521 - DNA, 489 bp, Neisseria gonorrhoeae
atgaattccctctttgtggacaacactgtttttattacacggctgaaagccgggcatatcggcaggttggttcaggcgttgtttgaggagtggcacggatttgaaccgtggtcttctgtggataagattcgtgcctattacggcagatgtttgaaggatgacgaactgccgctggcttttgcggctgtggatgattccggaaccctgttgggttcggctgcagtcaagcggcatgatatggaaaattttccacagtatgaatattggttgggcgatgtctttgttttacctgaatatcgcggaaaaggcattggcaggaggctggtcgcccactgcataggcgcagcgcgttcgctggggataaagttcttgtatctttatacgcctgatgtgcaaatattttatgaatcattcggctgggcggttgtcgggcgacatttccataacggggaatgggttacggttatgcgtttggatgtggataaggtt

SEQ ID NO: 8522 - protein, 163 aa, Neisseria gonorrhoeae
MNSLFVDNTVFITRLKAGHIGRLVQALFEEWHGFEPWSSVDKIRAYYGRCLKDDELPLAFAAVDDSGTLLGSAAVKRHDMENFPQYEYWLGDVFVLPEYRGKGIGRRLVAHCIGAARSLGIKFLYLYTPDVQIFYESFGWAVVGRHFHNGEWVTVMRLDVDKV

SEQ ID NO: 8523 - DNA, 126 bp, Neisseria gonorrhoeae
atgggcagatgccgtctgagctgttcggacggcattttttatgtttggaaatttcctgtcagatatagtggattaacaaaaaccggtacggcgttgccccgccccggctcaaagggaacggttccc

SEQ ID NO: 8524 - protein, 42 aa, Neisseria gonorrhoeae
MGRCRLSCSDGIFYVWKFPVRYSGLTKTGTALPRPGSKGTVP

SEQ ID NO: 8525 - DNA, 141 bp, Neisseria gonorrhoeae; identical to SEQ ID NO: 4521

SEQ ID NO: 8526 - protein, 47 aa, Neisseria gonorrhoeae; identical to SEQ ID NO: 4522

SEQ ID NO: 8527 - DNA, 204 bp, Neisseria gonorrhoeae
atggcacgtattaccaccgaagactgtaccggaaaaatttccaaccattttgacctgacattggtagcggcccgtcgggcccgccagcttgaaaatggcaatacgccgcttgtggacgatgtccgcaataacaaaccgaccgttaccgccttaagggaaatcgcagccgggcatatcggtacggaactgttgacgcgcaataaa

SEQ ID NO: 8528 - protein, 68 aa, Neisseria gonorrhoeae
MARITTEDCTGKISNHFDLTLVAARRARQLENGNTPLVDDVRNNKPTVTALREIAAGHIGTELLTRNK

SEQ ID NO: 8529 - DNA, 90 bp, Neisseria gonorrhoeae
atgatagatatgcttgctgcggtcaaaattattgttcattttctatatccgttcgtttacttcaaaaccactttcaaatacttcccggta

SEQ ID NO: 8530 - protein, 30 aa, Neisseria gonorrhoeae
MIDMLAAVKIIVHFLYPFVYFKTTFKYFPV

SEQ ID NO: 8531 - DNA, 228 bp, Neisseria gonorrhoeae
gtgcaaatccgtatcttaatttccgttggcggagcagcatcaaaccatatggaaaaatctgtggataaactttatggcggattaacaaaaatcaggacaaggcggcgggccgcaggcagtacaaatggtacggaaccggttcgcccggtgcttgggcgccttagggaaccgttccctttgagccggggcggggcaacgccgtaccggtttttgttaatccactatatc

SEQ ID NO: 8532 - protein, 76 aa, Neisseria gonorrhoeae
VQIRILISVGGAASNHMEKSVDKLYGGLTKIRTRRRAAGSTNGTEPVRPVLGRLREPFPLSRGGATPYRFLLIHYI

SEQ ID NO: 8533 - DNA, 2568 bp, Neisseria gonorrhoeae
atgatgcagcaatacctcggcataaaagcgcaacataccgacaaactagtgttttaccgtatgggtgatttttacgagctgtttttggatgacgcggtggaagcggcgaaattgttggacatcaccctgaccacacgcgggcagatggacggcgtgccgattaaaatggcaggcgttccgtttcacgcggcggaacagtatctggcgcgcctggtcaagttgggcaaaagcgtggcgatttgcgaacaggtcggcgaagtcggcgcgggcaaagggccggtggagcgcaaagtcgtgcgcatcgtaacgcccggcacgctaaccgattccgcattactggaagacaaggaaaccaaccgcatcgttgccgtgtctcccgacaaaaaatacatcggtttggcgtgggcatcgctgcaaagcggcgaattcaaaaccaagctgacaactgcggataaattgaacgacgaactggcgcgcctgcaggcggcggaaattttgctgccggacagtaaaaacgcaccgcaacttcagacggcatcgggtgttacacgcctgaacgcgtggcagtttgccgccgacgcgggggaaaaactgctgacggaatatttcggctgccaagatttgcgcggcttcggtttggacagcaaagaacacgccgtttcgattggcgcggcaggtgcgctgttgaactatatccgcctgacgcaaaacctgatgccgcaacatttggacggcctgtcgctcgaaaccgacagccaatatatcggcatggatgccgccacgcgccgcaatctcgaaatcacgcaaaccctctccggcaaaaaaacgccgaccctgttttccatactcgacggctgcgccacccacatgggcagccgcctgttggcattgtggctgcaccaccctttacgcaaccgcgcccacatccgagcgcgccaagaagccgtaaccgcgctggaaagccaatacgaacccctccaatgccatctgaagagcattgccgacatcgaacgtatcgccgcccgcatcgccgtcggcaatgcccgcccgcgcgatttggcatctttacgcgacagtctgttcgagttggcacaaatcgacttgtccgcaaccggcagcagcctgttggaaacccttaaagccgttttccccgaaaccctgcccgttgccgaaaccctcaaagccgccgtgatgcccgaaccttccgtctggctgaaagacggcaatgtcatcaaccacggttttcatcccgaactggacgaattgcgccgcattcaaaaccatggcgacgaatttttgctggatttggaagccaaggaacgcgaacgtaccggtttgtccacactcaaagtcgagttcaaccgcgttcacggcttttacattgaattgtccaaaacccaagccgaacaagcacctgccgactaccaacgccggcaaaccctcaaaaacgccgaacgcttcatcacgccggaactgaaagcctttgaagacaaagtgctgactgctcaagaccaagccctcgccttagaaaaacaactctttgacggcgtattgaaaaaccttcggacggcattgccgcagcttcaaaaagccgccaaagccgccgccgcgctggacgtgttatccacattttcagccttggcaaaagagcggaactttgtccgtcccgagtttgccgactatccggttgtccacatcgaaaacggccgccatcccgttgtcgaacagcaggtacgccacttcacagccaaccacaccgacctcgaccacaaacaccgcctcatgctgctcaccggccccaatatgggcggcaaatccacctatatgcgccaagtcgcgctgattgttttattggcacacaccggctgtttcgtgcctgccgatgccgccacaatcgggcctgtcgatcaaatcttcacccgcatcggcgcatcggacgacctcgcctccaaccgctccaccttcatggtcgaaatgagcgaaaccgcctacatcctgcatcacgccaccgaacaaagcattgttttaatggacgaagtcggacgtggtacttccactttcgacggcctcgccctcgcgcacgcaatcgccgaacacctgctgcaaaaaaacaaatccttcagcctgtttgccacccactatttcgagctgacctacctgcccgaagcccacgccgccgccgtcaatatgcacctttccgcgctcgaacagggacgggacatcgtgttcctgcaccaaatccaacccggtcccgccggaaaaagctacggcatcgccgtcgccaaactcgccggcctgcctgtgcgcgcattgaaagccgcccaaaagcatttgaacggactggaaaaccaagccgccgcaaaccgtccccaactggatattttcagtaccatgccgtctgaaaaaggagatgaaccgaatgtggactgctttgtggataaagcagaggaaaaacattttgaaggtatattggcagcagccctggaaaacctcgatcccgacagcctgaccccgcgcgaagcattgtcagaactgtaccgtctgaaagatttgtgcaaatccgtatct

SEQ ID NO: 8534 - protein, 856 aa, Neisseria gonorrhoeae
MMQQYLGIKAQHTDKLVFYRMGDFYELFLDDAVEAAKLLDITLTTRGQMDGVPIKMAGVPFHAAEQYLARLVKLGKSVAICEQVGEVGAGKGPVERKVVRIVTPGTLTDSALLEDKETNRIVAVSPDKKYIGLAWASLQSGEFKTKLTTADKLNDELARLQAAEILLPDSKNAPQLQTASGVTRLNAWQFAADAGEKLLTEYFGCQDLRGFGLDSKEHAVSIGAAGALLNYIRLTQNLMPQHLDGLSLETDSQYIGMDAATRRNLEITQTLSGKKTPTLFSILDGCATHMGSRLLALWLHHPLRNRAHIRARQEAVTALESQYEPLQCHLKSIADIERIAARIAVGNARPRDLASLRDSLFELAQIDLSATGSSLLETLKAVFPETLPVAETLKAAVMPEPSVWLKDGNVINHGFHPELDELRRIQNHGDEFLLDLEAKERERTGLSTLKVEFNRVHGFYIELSKTQAEQAPADYQRRQTLKNAERFITPELKAFEDKVLTAQDQALALEKQLFDGVLKNLRTALPQLQKAAKAAAALDVLSTFSALAKERNFVRPEFADYPVVHIENGRHPVVEQQVRHFTANHTDLDHKHRLMLLTGPNMGGKSTYMRQVALIVLLAHTGCFVPADAATIGPVDQIFTRIGASDDLASNRSTFMVEMSETAYILHHATEQSIVLMDEVGRGTSTFDGLALAHAIAEHLLQKNKSFSLFATHYFELTYLPEAHAAAVNMHLSALEQGRDIVFLHQIQPGPAGKSYGIAVAKLAGLPVRALKAAQKHLNGLENQAAANRPQLDIFSTMPSEKGDEPNVDCFVDKAEEKHFEGILAAALENLDPDSLTPREALSELYRLKDLCKSVS

SEQ ID NO: 8535 - DNA, 369 bp, Neisseria gonorrhoeae
ttgcgcttttatgccgaggtattgctgcatcattggggaaacggcggatttggacatggggctgccttattattaggaaaacggtattgtagcaaaaggttttgtcttcgacggaatgagactgaccgtaagcctgtcaataaagttgtggagacaaataggaaaacggcaaagttatccataagaatattattaagtcaaaaaacatccacgcttatctgtcttatacggcaagccttaaactcaaatttatttaacaaaaaggtaatgaaaatattggatatttgctacttatacacaagcaggtcggcaatcatcaaaatcatcattaaaattttaaaatcaaatattgaatgcgcgtttttgaaa

SEQ ID NO: 8536 - protein, 123 aa, Neisseria gonorrhoeae
LRFYAEVLLHHWGNGGFGHGAALLLGKRYCSKRFCLRRNETDRKPVNKVVETNRKTAKLSIRILLSQKTSTLICLIRQALNSNLFNKKVMKILDICYLYTSRSAIIKIIIKILKSNIECAFLK

SEQ ID NO: 8537 - DNA, 105 bp, Neisseria gonorrhoeae
ttgtttgacgcaggtgaatttcgctatttcaaaaacgcgcattcaatatttgattttaaaattttaatgatgattttgatgattgccgacctgcttgtgtataag

SEQ ID NO: 8538 - protein, 35 aa, Neisseria gonorrhoeae
LFDAGEFRYFKNAHSIFDFKILMMILMIADLLVYK

SEQ ID NO: 8539 - DNA, 1071 bp, Neisseria gonorrhoeae
gtggaatgtagttttatttcagaatacaatacaggcatcggactttatttcacaaccgggagacaaaatatgagcatcaaagtagcgattaacggtttcggccgcatcggccgcctcgcattgcgtcaaattgaaaaagcccacggcatcgaagtcgccgccgtcaacgacctgacccctgccgaaatgctgctgcaccttttcaaatacgacagcacacaaggccgtttccaaggtactgccgaattaaaagacgatgccatcgtggtaaacggcagagaaatcaaagttttcgccaatccgaatcccgaagaattgccttggggcgagttgggtgtggatgtcgtcctcgaatgtaccggtttctttaccaacaaaaccaaagccgaagcacatatccgtgccggcgcgcgcaaagtcgtgatttctgcacccggcggcaatgatgtgaaaaccgtcgtatatggcgtaaaccaagacatcttggacggtagcgaaactgtcatttccgccgcttcctgtaccaccaactgccttgccccgatggcggcagtcctgcaaaaagagttcggcgtagtcgaaggcctgatgaccaccatccacgcctacaccggcgaccaaaacacccttgacgcgccgcaccgcaaaggcgatttgcgccgcgcccgcgccgccgcgctcaacatcgtgcccaacagcaccggcgccgccaaagccatcggtctggttatccccgaattgaacggcaaactcgacggctccgcccaacgcgtccctgttgccaccggctcgctgaccgaattggtttccgtcctcgaacgccctgcaaccaaagaagaaatcaacgccgcgatgaaagccgcctccagcgaatcttacggctacaacgaagatcaaatcgtttcttccgacgttgtcggcatcgaatacggctcgctctttgacgcaacccaaacccgcgtgatgaccgtgggcggcaaacaactggtgaaaaccgttgcctggtacgacaacgaaatgtcctacacctgccaactcgtccgtactttggaatacttcgcaggcaaaatc

SEQ ID NO: 8540 - protein, 357 aa, Neisseria gonorrhoeae
VECSFISEYNTGIGLYFTTGRQNMSIKVAINGFGRIGRLALRQIEKAHGIEVAAVNDLTPAEMLLHLFKYDSTQGRFQGTAELKDDAIVVNGREIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVATGSLTELVSVLERPATKEEINAAMKAASSESYGYNEDQIVSSDVVGIEYGSLFDATQTRVMTVGGKQLVKTVAWYDNEMSYTCQLVRTLEYFAGKI

SEQ ID NO: 8541 - DNA, 120 bp, Neisseria gonorrhoeae
ttgaacaaacggctgttgtttgttcgccataagccgcaatatcaagttacagataaacaatgccgtctgaacgcaatgtgttcagacggcatttacttatccacaggtttgttcaagcct

SEQ ID NO: 8542 - protein, 40 aa, Neisseria gonorrhoeae
LNKRLLFVRHKPQYQVTDKQCRLNAMCSDGIYLSTGLFKP

SEQ ID NO: 8543 - DNA, 678 bp, Neisseria gonorrhoeae
atgacttataccattacccccatcggcaccgcccgctcgccctacaaacagaaattcggcatcgcccgccagcccggtttggtctccgccgcagaagcctgcatcgagctgaatcccgaatttaccgcagacagcgtgcgcgggttggaagatttcgattatgtgtggataagttttatcttccacggcgtattggatgaaggttgggcgcaaatggtgcgcccgccacggctcggcggcaaacaaaaaatgggcgtgttcgccacgcgcagcccccaccgccccaaccatctcggactctctctccttaaactcgaacgcatcgaaaccggcaaacccgtccgcctctattgcagcggctcagacctgctggacggcacgccgattgtggacatcaagccttatatcccctttatcgaatccaaacccgatgccgcatccggtttcgtcagcggcaaacccgtagagttggaagtcgtttggcaggaaaacatcggcgcggaaaatttatctgcaaacaccaaaaaccttatcagccaaagcattgcccaagatccgcgccccgcctatcagaatattcccgaacggatttatgtgatgaatattgcggattacgaagtcaggtttcaaatcgaggaaaaccgcgcgacggttattaatctttccccaaccccgctt

SEQ ID NO: 8544 - protein, 226 aa, Neisseria gonorrhoeae
MTYTITPIGTARSPYKQKFGIARQPGLVSAAEACIELNPEFTADSVRGLEDFDYVWISFIFHGVLDEGWAQMVRPPRLGGKQKMGVFATRSPHRPNHLGLSLLKLERIETGKPVRLYCSGSDLLDGTPIVDIKPYIPFIESKPDAASGFVSGKPVELEVVWQENIGAENLSANTKNLISQSIAQDPRPAYQNIPERIYVMNIADYEVRFQIEENRATVINLSPTPL

SEQ ID NO: 8545 - DNA, 135 bp, Neisseria gonorrhoeae; identical to SEQ ID NO: 4537

SEQ ID NO: 8546 - protein, 45 aa, Neisseria gonorrhoeae; identical to SEQ ID NO: 4538

SEQ ID NO: 8547 - DNA, 372 bp, Neisseria gonorrhoeae
ttggggggcgggcatttcagacggctttcgggatgtatgtgttttttcatttcaaaccgtcggactgcacggcggcagagtgtgtcggcgtgcgtttccggcagaatttatttattgcgcgtcaacagttccgtaccgatatgcccggctgcgatttcccttaaggcggtaacggtcggtttgttattgcggacatcgtccacaagcggcgtattgccattttcaagctggcgggcccgacgggccgctaccaatgtcaggtcaaaatggttggaaatttttccggtacagtcttcggtggtaatacgtgccatattatttgctttctttcaaaaatatttaaattgggaaaccggatattttcgcggtttt

SEQ ID NO: 8548 - protein, 124 aa, Neisseria gonorrhoeae
LGGGHFRRLSGCMCFFISNRRTARRQSVSACVSGRIYLLRVNSSVPICPAAISLKAVTVGLLLRTSSTSGVLPFSSWRARRAATNVRSKWLEIFPVQSSVVIRAILFAFFQKYLNWETGYFRGF

SEQ ID NO: 8549 - DNA, 468 bp, Neisseria gonorrhoeae; identical to SEQ ID NO: 111

SEQ ID NO: 8550 - protein, 156 aa, Neisseria gonorrhoeae; identical to SEQ ID NO: 112

SEQ ID NO: 8551 - DNA, 633 bp, Neisseria gonorrhoeae
atgattgtttccattgatgttgatgcacaaaaaacgtttacgccactgtgtcctgacgaactgcccgtgaacgaggggcatttgattgtcgaggagttaaatgcccaagccgctttggcggatttgcgtgtgatgacgaaagatgcgcatcatatggcggcgaaatggcttgtggataaccctgttgatatgttgaagccgacaggtttttccgatgcggatttgacttgggtggctcatgcgatggtcggtacgcgcggctatgaattgttggacggtctgccttccgtcaaggaatacgattattgcgtttggaaaggtgtcgatcccgaattgcatccttacggcgcgtgttttcacgatattgaggaaaaactgagcactggattgattgagtggctgcgttgtcaaaatacgaatatggtcattgtcggcggcttggctacggattattgtgttaaaacaacggttttgcagttacttaaaggcggtcgttggcaggttatcgtgaatgaagcggcttgtcggggtattgcgcccgataccattgaagcagcgtggcaggaaatgcgttcttcgggtgcgataattttgaaaaacgccgaaaaaattaaaaaatatattaataatcaa

SEQ ID NO: 8552 - protein, 211 aa, Neisseria gonorrhoeae
MIVSIDVDAQKTFTPLCPDELPVNEGHLIVEELNAQAALADLRVMTKDAHHMAAKWLVDNPVDMLKPTGFSDADLTWVAHAMVGTRGYELLDGLPSVKEYDYCVWKGVDPELHPYGACFHDIEEKLSTGLIEWLRCQNTNMVIVGGLATDYCVKTTVLQLLKGGRWQVIVNEAACRGIAPDTIEAAWQEMRSSGAIILKNAEKIKKYINNQ

SEQ ID NO: 8553 - DNA, 966 bp, Neisseria gonorrhoeae
atgaaaattttgcttgtccgtttgtccagtatgggtgatttaattcacactttgcccgcaatcgaagatttggcgcgacaatgctctgatgtagaactgcattggctatgtgaagccgggtttgcgggtattgcacggttgcatccgtttgtaaaaaaggtccatgtaatgaagtggcggcaatggcgcaaacatctctttcaggctgaaacttggcgggagatgggtcgtctgaaacaggctttgctgcaggaagcatttgattttgtattggacagtcagggtctgattaaaagcgcgtgtttcgccaaaatggcaaaatcccctatttatggtttggataaacacagtgcgcgtgagggggtggctgctttggcgtatgataaaaagtatgtcgtaccgaaaggtagaaatgccgtttggcgcaaccgtgatctgtttgcccaggtgtttgggtatgcaatgcctgagacgcaggtatttggtttgtccgttcctgaagcaagccgtctgaaaaatttagcgcagccgtattatgcggctttgcacgcgaccagtcgggacagtaagttatggcctatggaaaattggcgggagttgctgcagaaactgaatcaaaaacaacaatgcaatgtttatctgccttggggaaacgaggctgaaaaagtgcgtgcggaacagattgcagacgggctgccgtttaccatagtgtgcgctaaaatgaatttattacaggcggcgtatctgttgaaacacgcggttggaatagttggtgtagataccggtttgctgcatttggcaaatgccttggaaaaacctgtggtcggcatttataccgataccgatccgattaaaacaggcgttcaagtttcggctattgcaaaaaatgtgggcaatatcgggcagattccgaccgcagatttggtttatcaaacgctgatggattgtgtttcagcagataaaggc

SEQ ID NO: 8554 - protein, 322 aa, Neisseria gonorrhoeae
MKILLVRLSSMGDLIHTLPAIEDLARQCSDVELHWLCEAGFAGIARLHPFVKKVHVMKWRQWRKHLFQAETWREMGRLKQALLQEAFDFVLDSQGLIKSACFAKMAKSPIYGLDKHSAREGVAALAYDKKYVVPKGRNAVWRNRDLFAQVFGYAMPETQVFGLSVPEASRLKNLAQPYYAALHATSRDSKLWPMENWRELLQKLNQKQQCNVYLPWGNEAEKVRAEQIADGLPFTIVCAKMNLLQAAYLLKHAVGIVGVDTGLLHLANALEKPVVGIYTDTDPIKTGVQVSAIAKNVGNIGQIPTADLVYQTLMDCVSADKG

SEQ ID NO: 8555 - DNA, 747 bp, Neisseria gonorrhoeae
atgaaagcactggtcgcagtaaagcgcgtagtggactacaacgtcaaagtccgtgtgaaagccgatggttcggatgtggacatcggcaatgtcaaaatgtcgatgaacccgtttgatgaaatcgctgtggaagaagccgtccgtttgaaagaagccggaaaagtaagcgaaattgtagcggtttctttgggtgaaaagaaatgcgaagaaaccttgcgtaccgctttggcaatgggtgccgaccgtgccattcatattgaaaccgatgtgaaattagagccgctggcagttgccaaactgctgaaagctgttgcggacaaagaaaatccgcaaattttctttttgggcaaacaagcgattgatgacgatgccaatcaagtggcgcaaatgctggcagctttgctgaatgcggcgcaaggtacatttgtttcaaaagtacaaattgaaggtgatgaagtacagattgtgcgcgaaattgatggcggcgaagaaacgattgcgttgaaactgcctgcagtcatcagcgcagatttgcgtttgaacgagccgcgctttgtcaaactccccaatattatggtggcaaagaaaaaacctctggaaaaactggattctgccgatttggctaccgatatttcgcctcgtctgaaaacggtgaaatttgccgaacctaaggcgcgtcaggcaggcgtaaaagtagcaagcgttgccgaattggttgaaaaattgaaaaacgaagccaaagtgatt

SEQ ID NO: 8556 - protein, 249 aa, Neisseria gonorrhoeae
MKALVAVKRVVDYNVKVRVKADGSDVDIGNVKMSMNPFDEIAVEEAVRLKEAGKVSEIVAVSLGEKKCEETLRTALAMGADRAIHIETDVKLEPLAVAKLLKAVADKENPQIFFLGKQAIDDDANQVAQMLAALLNAAQGTFVSKVQIEGDEVQIVREIDGGEETIALKLPAVISADLRLNEPRFVKLPNIMVAKKKPLEKLDSADLATDISPRLKTVKFAEPKARQAGVKVASVAELVEKLKNEAKVI

SEQ ID NO: 8557 - DNA, 933 bp, Neisseria gonorrhoeae
atgagcgtattgattattgccgaacacgacaacaaacagttgaatcctgccactttgcatgctgttgccgctgccgccaaactgggcaaggtcgatttattggttgtcggaaacggcgcatcgtccgtcgtggaattcgcgaagcaagtagcgggagtggaaaaagttttggttgcagatgctgctcattatgctgaaggtttggctgaagagttggctccgctggttgtcaaattggcggcggattaccgctatgttgcagcaacggcaaccacattcggtaaaaaccttttgccccgcgtagccgccttattagacgtaccgcaaatttctgatttgaccgagattgtagataacacgacttttgtacgtccgatttatgcaggtaatgcatttgaaaccgtgcaagccgattcagaaaaattggtgctgaccttccgtgtgacggcttttgacgcagtggcggcgcaaggtggtaatgctgaggtaattaatgttaaaacaacccctgcccaaaacctgagtcgttttgttaaccgtcaactttcccattccgatcgtcccgaactgactcaggcaaaagtgattgtttccggtggtcgtgcgttgggtagtgtggaaaaattcagtgaagtgctgacaccgttggcggatgttttaggtgcggcaatcggtgcatcccgtgcggcggttgatgccgagtatgcaccaaacgatgctcaagtcggacaaaccggtaaggtggttgcgccgcagctctattttgcaatcggtatttcaggtgcgattcaacacgttgccggtatgcaggacagtaaggtgattgttgcaatcaacaaagatgccgatgcgccgattttcaatgtagccgattacggattggttggcgatttatttgaaattgttccacaattaatagaattattgaaaaat

SEQ ID NO: 8558 - protein, 311 aa, Neisseria gonorrhoeae
MSVLIIAEHDNKQLNPATLHAVAAAAKLGKVDLLVVGNGASSVVEFAKQVAGVEKVLVADAAHYAEGLAEELAPLVVKLAADYRYVAATATTFGKNLLPRVAALLDVPQISDLTEIVDNTTFVRPIYAGNAFETVQADSEKLVLTFRVTAFDAVAAQGGNAEVINVKTTPAQNLSRFVNRQLSHSDRPELTQAKVIVSGGRALGSVEKFSEVLTPLADVLGAAIGASRAAVDAEYAPNDAQVGQTGKVVAPQLYFAIGISGAIQHVAGMQDSKVIVAINKDADAPIFNVADYGLVGDLFEIVPQLIELLKN

SEQ ID NO: 8559 - DNA, 162 bp, Neisseria gonorrhoeae
ttggtattttttcacatcagccaatgtccgaatcggataggcaaatgcaataaaacggctgcctttatctttaaactcagcctgcgtcggggaagtaatggttttataagtcgtaatcatgctgaaatgttttcagacgacctcattaataacaaagtcgcc

SEQ ID NO: 8560 - protein, 54 aa, Neisseria gonorrhoeae
LVFFHISQCPNRIGKCNKTAAFIFKLSLRRGSNGFISRNHAEMFSDDLINNKVA

SEQ ID NO: 8561 - DNA, 141 bp, Neisseria gonorrhoeae
atgattacgacttataaaaccattacttccccgacgcaggctgagtttaaagataaaggcagccgttttattgcatttgcctatccgattcggacattggctgatgtgaaaaaataccaatctgttaaaggaagagcatta

SEQ ID NO: 8562 - protein, 47 aa, Neisseria gonorrhoeae
MITTYKTITSPTQAEFKDKGSRFIAFAYPIRTLADVKKYQSVKGRAL

SEQ ID NO: 8563 - DNA, 153 bp, Neisseria gonorrhoeae
tttcagtttggtttctttgtacactacgtgtttgcgggcaaccggatcgaattttttgatttccagtttgccgggcatagtgcgtttatttttggtagtggtgtagaagtggccagtacctgcaccggattccagtttgattttatcgcgcat

SEQ ID NO: 8564 - protein, 51 aa, Neisseria gonorrhoeae
FQFGFFVHYVFAGNRIEFFDFQFAGHSAFIFGSGVEVASTCTGFQFDFIAH

SEQ ID NO: 8565 - DNA, 639 bp, Neisseria gonorrhoeae
ttggaaaatatacaggtaaaaaatatgtccgcttatcgaaaaggcaacatctttatcatttcggccgcttccggcacgggcaaaaccacgctggtgtcgcggctgttggcaaaccataacggtttgcgcgtttccgtgtcgcatacgacgcgcccgccgcgtgaaggcgaagcaaacggcgtacattatcactttgtttccaaagaagagtttgaatcgcttatcgcgcaggaggcttttttggaatacgcagacgtattcggcaactattacggcacaagcacggagggcgtgaatgcgttggcggcggcaggctatgacgtgattttggaaatcgacgttcagggcgcggcgcaggttcgcaacgcgctgccggaagctgtcggtatctttatcctgccgccttctttcgacgtgcttgccgcgcgcctcaaagggcgcgggacggacagtcgggaagttatccaaaggaggctgtcgaaggcaaggcatgaaatcgaacagtccgtattgttcgactttgtcgtggtcaatgacgacctggagaaggcggagggggatttgcttcatattgtgaatgcctgccgtctgaaaaggtcgcggcaactgggatttattgcagatttgttggaaaattcc

SEQ ID NO: 8566 - protein, 213 aa, Neisseria gonorrhoeae
LENIQVKNMSAYRKGNIFIISAASGTGKTTLVSRLLANHNGLRVSVSHTTRPPREGEANGVHYHFVSKEEFESLIAQEAFLEYADVFGNYYGTSTEGVNALAAAGYDVILEIDVQGAAQVRNALPEAVGIFILPPSFDVLAARLKGRGTDSREVIQRRLSKARHEIEQSVLFDFVVVNDDLEKAEGDLLHIVNACRLKRSRQLGFIADLLENS

SEQ ID NO: 8567 - DNA, 429 bp, Neisseria gonorrhoeae
gtgaacgggatgcagtttcgcggcaacgatgatggagagccaccaggaagtgctgggcggccaattttgggacagattgattcggtgggtatcactgatgttttggtcgtggtcgtccgctatttcggtggtgctttattgggcgttcccggcttgattcacgcatacaaagaggcaacggctcaggcgttggcgatcgcggaagtggttgaaaagaatattgaaaaaaccgtttggctgaaatgtgagtatccgtttttgaatgaagcaatatgcattgccaaacaatatcaggcggatatattggagcaggatttgcagttggattgccgattgacggtaagtttgtcgttggcaaattatgaggcctgtgttgcggcttggaagaatacacggcaggttgaagtaaatacggaaaagccttttgaa

SEQ ID NO: 8568 - protein, 143 aa, Neisseria gonorrhoeae
VNGMQFRGNDDGEPPGSAGRPILGQIDSVGITDVLVVVVRYFGGALLGVPGLIHAYKEATAQALAIAEVVEKNIEKTVWLKCEYPFLNEAICIAKQYQADILEQDLQLDCRLTVSLSLANYEACVAAWKNTRQVEVNTEKPFE

SEQ ID NO: 8569 - DNA, 201 bp, Neisseria gonorrhoeae
atggacaatttctatacccacgagtatcaggtgcgccatcagactattgaagacggggtagaactgaatttgcaaacagaaggcgaatatagcattatgagtgaagatgcattatggaacgcgccgggcgaattccatcaattggcttggctatatttatgctccagcgtcgataccttagacagatatacacaagaaaat

SEQ ID NO: 8570 - protein, 67 aa, Neisseria gonorrhoeae
MDNFYTHEYQVRHQTIEDGVELNLQTEGEYSIMSEDALWNAPGEFHQLAWLYLCSSVDTLDRYTQEN

SEQ ID NO: 8571 - DNA, 1368 bp, Neisseria gonorrhoeae
gtggtcttttgtttgattctactaaaatttcttcagatgggacaaaagttcctttgtatcgagttttcgttaaaagtacatatttgtcaaggagatggcatgaaactgctggttatcggtaatggcggtcgcgaacacgcgctggcttggaagttggcgcagtcgcccaaagtggaaacagtatttgttgcgcccggtaatgccggtacggcgattgaatccaagctccaaaacattgccttgaccgcgtatcaggatttgattgaattctgccgtaaagaaaatattgtttttaccgtcgtcggccctgaagcgcctttggcggcaggtattgtggatgattttcgtgccgcagggctgaaaatatttggtccgacacaatatgcggcgcagttggaaagttctaaagatttcgccaaagcatttatggtgaaatacaatattccgaccgcgcaataccaaacctttgaaaatgccgatgccgcacatgattacgtcaatcagaaaggtgcgcctatcgttatcaaagccgatggtttggtggcaggtaaaggcgtgattgtggcaatgactttggatgaagcgcatgctgcgattgacgatatgttgttgggcaataaaatgggcaatgccggcgaacgcgttgtgattgaagattttctgcaaggcgaagaagcgagctttatcgttatggttgatggcaatcatgtattgcctatggcgaccagtcaagaccacaaacgtcttttagacggagataaaggcccgaatacgggcggtatgggtgcgtacagtcccgcgcctgtggtaacgcctgctgtgtacgagcgtgcgatgaacgagattattttgccgaccgtagcgggtatgaaagcggaggggcacgagtttaccggctttttgtacgcaggtttgatgatcgatcaaagcggtgcaccctatacgattgagtttaactgccgtttcggcgatcccgaaacccagccgattatgagccgtctaaacagcgatttggcggatttggttgaagcggcaatagacggcagactggacagcgtcaaagcggaatggaatccgcaaactgccgtgggtgtggtactggcggcgcaaaattaccccgaaacacccaagaaaggcgatgttatttccggtttggatgacgtcaaccgaatcggcaaagtattccatgccggcacaacggtaaacgagaaaggcgacgtgttgaccaacggcgggcgcatattgtgtgttgtaggattgggcgacgatgtggcgcaagcgaaagccaaggcgtatggcgcgttggaaaaaatcagcttcgacgggatgcaataccgtaaagacattgccgataaagcgattaaccgt

SEQ ID NO: 8572 - protein, 456 aa, Neisseria gonorrhoeae
VVFCLILLKFLQMGQKFLCIEFSLKVHICQGDGMKLLVIGNGGREHALAWKLAQSPKVETVFVAPGNAGTAIESKLQNIALTAYQDLIEFCRKENIVFTVVGPEAPLAAGIVDDFRAAGLKIFGPTQYAAQLESSKDFAKAFMVKYNIPTAQYQTFENADAAHDYVNQKGAPIVIKADGLVAGKGVIVAMTLDEAHAAIDDMLLGNKMGNAGERVVIEDFLQGEEASFIVMVDGNHVLPMATSQDHKRLLDGDKGPNTGGMGAYSPAPVVTPAVYERAMNEIILPTVAGMKAEGHEFTGFLYAGLMIDQSGAPYTIEFNCRFGDPETQPIMSRLNSDLADLVEAAIDGRLDSVKAEWNPQTAVGVVLAAQNYPETPKKGDVISGLDDVNRIGKVFHAGTTVNEKGDVLTNGGRILCVVGLGDDVAQAKAKAYGALEKISFDGMQYRKDIADKAINR

SEQ ID NO: 8573 - DNA, 600 bp, Neisseria gonorrhoeae
atgactgatgcgcttcagacggcattttatattatgttattttcgagaattatcgcagcatcagcgcaacgtaagttaagcgtttatttgaaaaaaggcggtttggttgcttatccgaccgaatcttgttatggcttggggtgtcttccgacattagccaaagcactcggtaagttggcgcatttgaaaaaaaggccgcaacacaagggtatgattgtcatcgggaatcaacttgaacaattgcagcctttacttcaaatgccgtctgaaaacattcaaaccatgcttagaaacgaatggcctgctcctaagactttcctattgttggctaaatctggcgtattacctgcgttgcgcgggaagaggcgcagcaagcttgcggtcagagtgcccgatcatacaggtgcaaggcgtttgtgtcaggcattgggtatgcctttggtttccacttcatgtaatcgggcgggtaaacgcgcgtgtcggacggagagggaagtcagaaggcagttcggacgcgatgtgtggattgtcggtgggagaatcggcaggcagaaatcgccgagtcagattatcgatggggaaacaggtaaacgtttgcgt

SEQ ID NO: 8574 - protein, 200 aa, Neisseria gonorrhoeae
MTDALQTAFYIMLFSRIIAASAQRKLSVYLKKGGLVAYPTESCYGLGCLPTLAKALGKLAHLKKRPQHKGMIVIGNQLEQLQPLLQMPSENIQTMLRNEWPAPKTFLLLAKSGVLPALRGKRRSKLAVRVPDHTGARRLCQALGMPLVSTSCNRAGKRACRTEREVRRQFGRDVWIVGGRIGRQKSPSQIIDGETGKRLR

SEQ ID NO: 8575 - DNA, 513 bp, Neisseria gonorrhoeae
gtgaaaacttttttgcatacacaaagaaaaaattttttggatggtatttctctacatgattgttatcgcacggcgataaaggtagaaggacgcaacgtctgctttgattttgaggacggttttgtcgttctggacaataatccgaacaatcaagcgggcaagcatctgaaaacagatttttcccgtgttgttttaacccatgaaaatagaaacgccgaagacgactatttggtcgatatttttgaagacatcgtctttttagggaaacgtttgtttacagtcagaaaatttcttgatttttctgaattgcttgaaatgatcaatgcacaaggctattttcttgaatttctgtatctgtatgaatgtatcggtgtcaaaacaagcgattattttttagaggctgtgttggttacgggacggagccgggaatgtaaaaaatgctttatcaaaattatgagggcaagcagttttgtgtatcaatggaacaatttacgtttgaatagtgagattgta

SEQ ID NO: 8576 - protein, 171 aa, Neisseria gonorrhoeae
VKTFLHTQRKNFLDGISLHDCYRTAIKVEGRNVCFDFEDGFVVLDNNPNNQAGKHLKTDFSRVVLTHENRNAEDDYLVDIFEDIVFLGKRLFTVRKFLDFSELLEMINAQGYFLEFLYLYECIGVKTSDYFLEAVLVTGRSRECKKCFIKIMRASSFVYQWNNLRLNSEIV

SEQ ID NO: 8577 - DNA, 126 bp, Neisseria gonorrhoeae
atgaaaccgtatgcgggaaaaaactctgatttcaacttatacacaaatttatccataagccttattataaaaatgccgtctggaatactgaaatatcagcatttcagacgacattttgccattccc

SEQ ID NO: 8578 - protein, 42 aa, Neisseria gonorrhoeae
MKPYAGKNSDFNLYTNLSISLIIKMPSGILKYQHFRRHFAIP

SEQ ID NO: 8579 - DNA, 282 bp, Neisseria gonorrhoeae
gtgagaaaaaacggaaatctgatgattttccaagataaaaaagttgttaccaatctgaaacaagaacgttttgccaacacccccgcatacaagactgccattgccgagtgggaaatccactgcaacaacaaaacataccgcttaagttcgctacagttatttgatacaaaaaacacggaaatttccacacaaaactacacagcctcttccctccgcccgatgagcatcctgtccgggacattaactgaaaaacaatatgaaaccgtatgcgggaaaaaactc

SEQ ID NO: 8580 - protein, 94 aa, Neisseria gonorrhoeae
VRKNGNLMIFQDKKVVTNLKQERFANTPAYKTAIAEWEIHCNNKTYRLSSLQLFDTKNTEISTQNYTASSLRPMSILSGTLTEKQYETVCGKKL

SEQ ID NO: 8581 - DNA, 735 bp, Neisseria gonorrhoeae
ttgggaaaccggatattttcgcggtttttaggaattttccaacaaatctgcaataaatcccagttgccgcgaccttttcagacggcaggcattcacaatatgaagcaaatccccctccgccttctccaggtcgtcattgaccacgacaaagtcgaacaatacggactgttcgatttcatgccttgccttcgacagcctcctttggataacttcccgactgtccgtcccgcgccctttgaggcgcgcggcaagcacgtcgaaagaaggcggcaggataaagataccgacagcttccggcagcgcgttgcgaacctgcgccgcgccctgaacgtcgatttccaaaatcacgtcatagcctgccgccgccaacgcattcacgccctccgtgcttgtgccgtaatagttgccgaatacgtctgcgtattccaaaaaagcctcctgcgcgataagcgattcaaactcttctttggaaacaaagtgataatgtacgccgtttgcttcgccttcacgcggcgggcgcgtcgtatgcgacacggaaacgcgcaaaccgttatggtttgccaacagccgcgacaccagcgtggttttgcccgtgccggaagcggccgaaatgataaagatgttgccttttcgataagcggacatattttttacctgtatattttccaaccgattgtatcacaacggacaccctatttcatatttgccgatgcccatattttgccgctattgttt

SEQ ID NO: 8582 - protein, 245 aa, Neisseria gonorrhoeae
LGNRIFSRFLGIFQQICNKSQLPRPFQTAGIHNMKQIPLRLLQVVIDHDKVEQYGLFDFMPCLRQPPLDNFPTVRPAPFEARGKHVERRRQDKDTDSFRQRVANLRRALNVDFQNHVIACRRQRIHALRACAVIVAEYVCVFQKSLLRDKRFKLFFGNKVIMYAVCFAFTRRARRMRHGNAQTVMVCQQPRHQRGFARAGSGRNDKDVAFSISGHIFYLYIFQPIVSQRTPYFIFADAHILPLLF

SEQ ID NO: 8583 - DNA, 1131 bp, Neisseria gonorrhoeae; identical to SEQ ID NO: 113

SEQ ID NO: 8584 - protein, 377 aa, Neisseria gonorrhoeae; identical to SEQ ID NO: 114

SEQ ID NO: 8585 - DNA, 294 bp, Neisseria gonorrhoeae
ttgccgtttgagattgtgccgatattttcccatcgggcagacttgtccggtgtgctgcaggcggttatcaaaatagggagtaaaacgaaagataggaagattgggcgcattagggtttccttaatcattgaaatccgctcattcagaaagaacgggttgggcgggaggggtaatgccgtctgtgaaatgaggcaaatatgggaaattgatgcagccttcgtgttttacgtatttatatattccgtatggaggaatatgctgcttttgaagagtgtattatggatgaactgccga

SEQ ID NO: 8586 - protein, 98 aa, Neisseria gonorrhoeae
LPFEIVPIFSHRADLSGVLQAVIKIGSKTKDRKIGRIRVSLIIEIRSFRKNGLGGRGNAVCEMRQIWEIDAAFVFYVFIYSVWRNMLLLKSVLWMNCR

SEQ ID NO: 8587 - DNA, 93 bp, Neisseria gonorrhoeae
atggaggaatatgctgcttttgaagagtgtattatggatgaactgccgataacagtaaatcggtttgatttgtttccgtcagcttatgccgtc

SEQ ID NO: 8588 - protein, 31 aa, Neisseria gonorrhoeae
MEEYAAFEECIMDELPITVNRFDLFPSAYAV

SEQ ID NO: 8589 - DNA, 96 bp, Neisseria gonorrhoeae
ttgatttgtttccgtcagcttatgccgtctgaagccctttcagacggcatttattttgaagttctggttgtttttgccagtgatattttgatggtt

SEQ ID NO: 8590 - protein, 32 aa, Neisseria gonorrhoeae
LICFRQLMPSEALSDGIYFEVLVVFASDILMV

SEQ ID NO: 8591 - DNA, 210 bp, Neisseria gonorrhoeae
atggttcaaccaagaaaacccgaagtaaacgttatgaaaaaatgccgcgatattgccctgcttctttccaaacatcaggaccgggaaaccaccccgggcgagaagatttccatatatatgcacctgctgttctgcccgcattgccgggaatataaaagacagcttcaaaccatcaaaatatcactggcaaaaacaaccagaacttcaaaa

SEQ ID NO: 8592 - protein, 70 aa, Neisseria gonorrhoeae
MVQPRKPEVNVMKKCRDIALLLSKHQDRETTPGEKISIYMHLLFCPHCREYKRQLQTIKISLAKTTRTSK

SEQ ID NO: 8593 - DNA, 585 bp, Neisseria gonorrhoeae
atgccgctacccgacctgaccgatgccgaattaatggagtcgcgcaaactgcttctgcattttgcgcggctccagttgcccgaccaccctgatttggctgaagatttagtgcaggaaacattgctgtccgcatacagcgcaggcgacagttttcaaggcagggcacttgtcaacagctggctttttgccatattgaaaaacaaaattattgacgcattacgtcaaatcgggaggcagaggaaagtctttaccgcactggatgacgagctgctggatgaagcatttgaaagccatttttcccaaaacgggcattggacgccggaagggcagccgcaacattggaacactccggaaaaatcattaaataacaacgaattccaaaaaattctgcaaagctgcctatacaacctgcctgaaaacaccgcacgggtattcaccctgaaggaaatactcggtttttcatccaacgaaatacaacaaatgtgcggtatcagcacgtccaactaccacaccattatgcaccgcgcccgagaatcattgcgccaatgcctgcaaatcaaatggttcaaccaagaaaacccgaag

SEQ ID NO: 8594 - protein, 195 aa, Neisseria gonorrhoeae
MPLPDLTDAELMESRKLLLHFARLQLPDHPDLAEDLVQETLLSAYSAGDSFQGRALVNSWLFAILKNKIIDALRQIGRQRKVFTALDDELLDEAFESHFSQNGHWTPEGQPQHWNTPEKSLNNNEFQKILQSCLYNLPENTARVFTLKEILGFSSNEIQQMCGISTSNYHTIMHRARESLRQCLQIKWFNQENPK

SEQ ID NO: 8595 - DNA, 792 bp, Neisseria gonorrhoeae
ttgccaaaattgccgattatcaaacgcgtgccggaaaggaataccgccgtgcagcctgaaacctccgcccaataccagcaccgtttctcccaagccatacgcgggggcgaagccgcagacggtctgccgcaagaccgattgaacgtctatatccgcctgatacgcaacaatatccacagctttatcgaccgctgctataccgaaacgcggcaatactttgacagcaaagaatggagccgtctgaaagaaggtttcgtccgcgacgcgcgtgcccaaacgccctattttcaagaaatccccggcgagttcctacaatattgccaaagcccgccgctttcagacggcattttggcgctgatggattttgaatatacccaattgctggcagaagttgcacaaattccggatattcccgacattcattattcaaatgacagcaaatacacgccctcccctgcggcctttatccggcaatatcgatacgatgttacccatgatttgcaggaagcggaaacagccttgttaatatggcgaaacgccgaagatgatgtgatgtaccaaacattggacggcttcgatatgatgctgctggagataatgggttcctccgcgctttcgtttgacaccctcgcccaaacccttgtcgaatttatgcctaaagccgataattggaaaaatattttgcttgggaaatggtcaggctggattgaacaaaggattatcatcccctccttgtccgccatatccgaaaatatggaaggcaattccccgagccaaaaccatctatccgca

SEQ ID NO: 8596 - protein, 264 aa, Neisseria gonorrhoeae
LPKLPIIKRVPERNTAVQPETSAQYQHRFSQAIRGGEAADGLPQDRLNVYIRLIRNNIHSFIDRCYTETRQYFDSKEWSRLKEGFVRDARAQTPYFQEIPGEFLQYCQSPPLSDGILALMDFEYTQLLAEVAQIPDIPDIHYSNDSKYTPSPAAFIRQYRYDVTHDLQEAETALLIWRNAEDDVMYQTLDGFDMMLLEIMGSSALSFDTLAQTLVEFMPKADNWKNILLGKWSGWIEQRIIIPSLSAISENMEGNSPSQNHLSA

SEQ ID NO: 8597 - DNA, 864 bp, Neisseria gonorrhoeae
gtgccatccgaaccgggtaaaaatatgattcaacacgcaggcttgggctaccgccgcgatttggcggaagactttctctcgctttccgaaaacagcccgatatgctttatcgaagccgcaccggaaaactggctgaaaatgggcggcagggcgcgcaaacagtttgaccgtgtggcggaacggctgccgctggcgttgcacggattatctatgtcgctgggcggacaagccccgctggataccgatttgatagacggcatcaaagaaatgatgtgccgttatgactgcacgtttttctccgatcatttgagctactgccacgacggcggtcatctttacgatttgttgccgctgcctttcactgaagaaatggtgcatcatacggcgcggcgtatccgcgaagtgcaagaccgtttgggctgccgcatcgccgtggaaaacacgtcctactacctgcattctccgcttgccgagatgaacgaggtcgagttcctcaacgcggttgcccgtgaagccgactgcggtattcatttggatgtgaacaatatttacgtcaacgctgtcaatcacggcctgctgtcgcctgaggcctttttagagaatgtggacgcagggcgcgtgtgctacatccacatcgccggacacgatgccgaaacccccgagcttttgattgatacccacggcgcggcggttttaccgaccgtttgggacttgctcgaactcgcctacaccaagcttcccaccatccctcccaccctgttggaacgcgatttcaatttcccaccttttgccgaactcgaagccgaagttgccaaaattgccgattatcaaacgcgtgccggaaaggaataccgccgtgcagcc

SEQ ID NO: 8598 - protein, 288 aa, Neisseria gonorrhoeae
VPSEPGKNMIQHAGLGYRRDLAEDFLSLSENSPICFIEAAPENWLKMGGRARKQFDRVAERLPLALHGLSMSLGGQAPLDTDLIDGIKEMMCRYDCTFFSDHLSYCHDGGHLYDLLPLPFTEEMVHHTARRIREVQDRLGCRIAVENTSYYLHSPLAEMNEVEFLNAVAREADCGIHLDVNNIYVNAVNHGLLSPEAFLENVDAGRVCYIHIAGHDAETPELLIDTHGAAVLPTVWDLLELAYTKLPTIPPTLLERDFNFPPFAELEAEVAKIADYQTRAGKEYRRAA

SEQ ID NO: 8599 - DNA, 297 bp, Neisseria gonorrhoeae
agcttcgccgcgagcacgcaaatcagccaatacgacatcaatgcctactttgtcgatggtacgcaatgcagcgttggaaacgcgcaggcgaacccagcggttttcactttctacccaaaaacgacgtgattgcaagttgggcaaaaaacggcgtttggttttgttgttggcgtgcgatacgttgttgccggacatcgggcgtttaccggtcactttgcaaactcgtgccataatcagtctccaaacttctaaaatagtaaaacgcgatttataccacgaaaaacaatgccgtttcaa

SEQ ID NO: 8600 - protein, 42 aa, Neisseria gonorrhoeae
SFAASTQISQYDINAYFVDGTQCSVGNAQANPAVFTFYPKTT

SEQ ID NO: 8601 - DNA, 96 bp, Neisseria gonorrhoeae
ttgatgtttttaacgccatattgtagccgtcagcctgccgcttgccaaatcaatcaaaacaatagcggcaaaatatgggcatcggcaaatatgaaa

SEQ ID NO: 8602 - protein, 32 aa, Neisseria gonorrhoeae
LMFLTPYCSRQPAACQINQNNSGKIWASANMK

SEQ ID NO: 8603 - DNA, 336 bp, Neisseria gonorrhoeae
atgaacaaaaatattgctgccgcactcgccggtgctttatccctgtctctggccgccggcgccgttgccgcccacaaaccggcaagcaacgcaacaggcgttcaaaaatccgcccaaggctcttgcggcgcatccaaatctgccgaaggttcgtgcggcgcatccaaatctgccgaaggttcgtgcggcgcggctgcttctaaagcaggcgaaggcaaatgcggcgagggcaaatgcggtgcaactgtaaaaaaagcccacaaacacaccaaagcatctaaagccaaagccaaatctgccgaaggcaaatgcggcgaaggcaaatgcggttctaaa

SEQ ID NO: 8604 - protein, 112 aa, Neisseria gonorrhoeae
MNKNIAAALAGALSLSLAAGAVAAHKPASNATGVQKSAQGSCGASKSAEGSCGASKSAEGSCGAAASKAGEGKCGEGKCGATVKKAHKHTKASKAKAKSAEGKCGEGKCGSK

SEQ ID NO: 8605 - DNA, 447 bp, Neisseria gonorrhoeae
atgaaaatcggaacaacttggcagacggcatccgctatgctggttttgcgtctatttgccgcatatgaatttttggaatcgggtttgcaaaaatggaacggggagaattggttttccgaaatcaacgatcagtttccattcccgttcaacttgctgccggacgcgttaaactggaatctcgccatgtatgcggagcttttgctgcccgtactgttgcttttgggtttggcaacgcgcctgtcggcattggggctgatggtcgttaccgccgtcgcttgggctgcggttcacgccggttcgggttacaatgtctgcgacaacggttataaaatggctttaatttatatcgtggtattaatcccgctgcttttccagggtgcgggcggatggtcgctggatacgctgctgaaaaaactgttttgccccaaatgccgtctgaaacaagat

SEQ ID NO: 8606 - protein, 149 aa, Neisseria gonorrhoeae
MKIGTTWQTASAMLVLRLFAAYEFLESGLQKWNGENWFSEINDQFPFPFNLLPDALNWNLAMYAELLLPVLLLLGLATRLSALGLMVVTAVAWAAVHAGSGYNVCDNGYKMALIYIVVLIPLLFQGAGGWSLDTLLKKLFCPKCRLKQD

SEQ ID NO: 8607 - DNA, 900 bp, Neisseria gonorrhoeae
atggaaaatatggtaacgttttcaaaaatcagatcatttttggcaatcgccgccgccgcgttgcttgccgcctgcggtacggcgggaaacaatgccgcccgcaagccggtgcaaaccgccaaacccgccgcagtggtcgctttggcactcggtggcggcgcatctaaaggatttgcccatataggaattgttaaggttttgaaagaaaacggtattcctgtgaaggtggttaccggcacatcggcaggttcgatagtcggcagccttttggcatcgggtatgtcgcccgaccgcctcgaattggaagccgagattttaggtaaaaccgatttagtcgatttaaccttgtccaccagtggttttatcaaaggcgaaaagctgcaaaattacatcaaccgaaaagtcggcggcaggcagattcagcagtttcccatcaaatttgccgccgttgccactgattttgaaaccggcaaggccgtcgctttcaatcaagggaatgccgggcaggcggttcgtgcttccgccgccattcccaatgtgttccagccagtcatcatcggcaggcacaaatatgttgacggcggtctgtcgcagcccgtgcccgtcagtgccgctcggcggcagggggcgaatttcgtgattgccgtcgatatttccgcacgtccgagcaaaaatgtcggtcaaggtttcttctcttatctcgatcagacgctgaacgtgatgagcgtttccgtgttgcaaaacgagttggggcaggcggatgtggttatcaaaccgcaggttttggatttgggtgcagtcggcggattcgatcagaaaaagcgcgccatccggttgggcgaggaggcagcacgtgccgcattgcctgaaatcaaacgcaaactggcggcataccgttat

SEQ ID NO: 8608 - protein, 300 aa, Neisseria gonorrhoeae
MENMVTFSKIRSFLAIAAAALLAACGTAGNNAARKPVQTAKPAAVVALALGGGASKGFAHIGIVKVLKENGIPVKVVTGTSAGSIVGSLLASGMSPDRLELEAEILGKTDLVDLTLSTSGFIKGEKLQNYINRKVGGRQIQQFPIKFAAVATDFETGKAVAFNQGNAGQAVRASAAIPNVFQPVIIGRHKYVDGGLSQPVPVSAARRQGANFVIAVDISARPSKNVGQGFFSYLDQTLNVMSVSVLQNELGQADVVIKPQVLDLGAVGGFDQKKRAIRLGEEAARAALPEIKRKLAAYRY

SEQ ID NO: 8609 - DNA, 132 bp, Neisseria gonorrhoeae
gtgttgttgagctggttgattacttcggcttccatgattctttcgttctttcaaaattttaggggcgtattgtacgggattcgggtatttttttctatggatgaagccttctggaaacacgttcggacggca

SEQ ID NO: 8610 - protein, 44 aa, Neisseria gonorrhoeae
VLLSWLITSASMILSFFQNFRGVLYGIRVFFSMDEAFWKHVRTA

SEQ ID NO: 8611 - DNA, 597 bp, Neisseria gonorrhoeae
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtcctgcaaagtgcggaatacttccgccttttggtcgatttgctggtttaccgctatatggatcagaaaatcgacatcgttgccggcttggacgcgcgcggcttcattatcggcgcggcactcgcctaccagctcaacgtcggcttcgtccccatccgcaaaaaaggcaagctgccttttgaaaccgtatcgcaaagctacgcgctcgaatacggggaagctgcggtggaaatccacaccgatgccgtcaaacccggttcgcgcgtcctgctggtcgatgatttggttgccacgggcggcacaatgcttgccgggctggaactgatccgcaaactcggcggggaaattgtcgaagccgccgccattttggaatttaccgaccttcaaggcggcaagaatatccgcgcaagtggcgcgcccttatttaccctgcttcaaaacgaaggctgcatgaaaggc

SEQ ID NO: 8612 - protein, 199 aa, Neisseria gonorrhoeae
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 8613 - DNA, 162 bp, Neisseria gonorrhoeae
aagaaaaacagatgttttgcgcgggtaagccgcccgagtgccgcatctgcggaacgtttgcaggtgcgaaacagatggggcgcgattatagcggatttcgggagcttctgcattcaaaatgccgtccgaacatatttccagtattttcagacggcatttcaa

SEQ ID NO: 8614 - protein, 54 aa, Neisseria gonorrhoeae
KKNRCFARVSRPSAASAERLQVRNRWGAIIADFGSFCIQNAVRTYFQYFQTAFQ

SEQ ID NO: 8615 - DNA, 132 bp, Neisseria gonorrhoeae
ttgttggacctgatgtttccaaacgacattggaggccgtctgaaagcactagcttcaacgaagttaaaagttgaaacggcaaaccgtcaatcaagcaaccgcgtgcgtaccgcacacacgcagtgggcgggt

SEQ ID NO: 8616 - protein, 44 aa, Neisseria gonorrhoeae
LLDLMFPNDIGGRLKALASTKLKVETANRQSSNRVRTAHTQWAG

SEQ ID NO: 8617 - DNA, 954 bp, Neisseria gonorrhoeae; identical to SEQ ID NO: 3045

SEQ ID NO: 8618 - protein, 318 aa, Neisseria gonorrhoeae; identical to SEQ ID NO: 3046

SEQ ID NO: 8619 - DNA, 201 bp, Neisseria gonorrhoeae; identical to SEQ ID NO: 2137

SEQ ID NO: 8620 - protein, 67 aa, Neisseria gonorrhoeae; identical to SEQ ID NO: 2138

SEQ ID NO: 8621 - DNA, 297 bp, Neisseria gonorrhoeae
atgcctaatagttttccgaatcgaataccttcgcccgataacgccctaaggaaattttttggacatcgcgaaccttgtcctgctgaaaatacaaaaggccgcgttcgacgatgtggggcggaaataggaggggtaggtagatacgggacatggtttgcttccaaggagttgttgaaatatggggaatttactggtttgggcgatgtttggggagaggggtgggaattcttgttttgcgaagtggaaaaaggtcgtctgaaaatgggtttcagacgacctttctgtgaaatgtgcatt

SEQ ID NO: 8622 - protein, 99 aa, Neisseria gonorrhoeae
MPNSFPNRIPSPDNALRKFFGHREPCPAENTKGRVRRCGAEIGGVGRYGTWFASKELLKYGEFTGLGDVWGEGWEFLFCEVEKGRLKMGFRRPFCEMCI

SEQ ID NO: 8623 - protein, 136 aa, Neisseria gonorrhoeae
SLTVGNALLGQMRRRFVQCCGIGRDVFGKTRVVQRFAPFPQGADDGYADTAHQHAQEIRQAAGGGNLSALHVRQCDGGQRQEEHGNAYPLPKLRPDDVADIHVGIKISAPIKSEGKGQEAGGYEQAHIDFIAEPAD

SEQ ID NO: 8624 - protein, 26 aa, Neisseria gonorrhoeae
EDGEDADGRGSKPCPRGGIAQVGLQH

SEQ ID NO: 8625 - protein, 30 aa, Neisseria gonorrhoeae
RQQGQRPHIHHETQRGGNYADGKIPIFKQR

SEQ ID NO: 8626 - protein, 45 aa, Neisseria gonorrhoeae
IDNRIFFSQFPNNKIRQAHQRGYAQGNDFSRGEPVKFLTPVQHHL

SEQ ID NO: 8627 - protein, 88 aa, Neisseria gonorrhoeae
RADTDHHQRQPDIVGRRSDGCRFAVFQMFPCNPCRYDPDGDINEENPTPMPVSGNPTAEYRPEDRGDNDGHCPQCQCQHPFCGRIGCH

SEQ ID NO: 8628 - protein, 98 aa, Neisseria gonorrhoeae
QALRQGNQRPGDKALQNAENNQRLKVGRDAAQPRCDDETGGGGGKQFDLADTFCQKARQRHGNGVCHGKRSDDPRPLRGCRTEVAGNDGDGDVGDGRI

SEQ ID NO: 8629 - protein, 34 aa, Neisseria gonorrhoeae
NLHKYGKPQRQRNPRQCRTLKRWIIHCVLRFRRH

SEQ ID NO: 8630 - protein, 212 aa, Neisseria gonorrhoeae
NRRACGGSIHFNRHRQTDTQRMPVHIFAVQHDTDGDALHHFNPVARCVLRRNQRKRAARTCRKPCHPAAINNLFAVQIGHQLGRLSDFHMPQLRLFKIGIHPHIRQRHHRHQRRACRHLLPDLHRTLRHLTVRRRADLRPPKVQPRIFQPADCRLNLRLFAQRNISAQSRACRRFFRQSRLNRRLRLRHCRTGVCQLFGGHRTRFRQSGPAA

SEQ ID NO: 8631 - protein, 98 aa, Neisseria gonorrhoeae
IILRARQIRTAQGNLRPRLRSGGILPAVLAHRLNQLVFCPLVSQHIIIVIQHRQHVAFFHGIRIVVQNLPHRAALLRRNLNHASGNISVFRFLFVLPP

SEQ ID NO: 8632 - protein, 47 aa, Neisseria gonorrhoeae
KKRRSGGCGGKREQQRQCRQAAFAFDLRVLKFCFVCVRFHKIGFRIS

SEQ ID NO: 8633 - protein, 9 aa, Neisseria gonorrhoeae
HGKHRRPHH

SEQ ID NO: 8634 - protein, 42 aa, Neisseria gonorrhoeae
KYISFIYDMANTAARTMPSEENYTNTAAYITIAAPWFENLPH

SEQ ID NO: 8635 - protein, 185 aa, Neisseria gonorrhoeae
GFADFDGHFRPRQRTARRRFDHDRTQCRQNLHIRIRSRPPPYAAFFFQSDQIALAVFVGKKLHFARTAVAADQNMNRLVGTQMPQIGFAAIFFRDSGNLVPRHTRTRQHVRQRVARLHRLLHPICRLNAAAAPRQRRQFLFHALRSDALRPLCRSNVCRRHQNNRNGKRAQRVFPMFCRKWEDSH

SEQ ID NO: 8636 - protein, 13 aa, Neisseria gonorrhoeae
VNRQNHADTGNIV

SEQ ID NO: 8637 - protein, 71 aa, Neisseria gonorrhoeae
DHCGIHGTRQQFGIFQQGFAVNLQNFSFFPHLPRYLLPVDRFDLRFMKPELGTASQIRFARCFFGVCRACQ

SEQ ID NO: 8638 - protein, 26 aa, Neisseria gonorrhoeae
RQQHPSVSCRHKCLPTKIKIKNNHYQ

SEQ ID NO: 8639 - protein, 59 aa, Neisseria gonorrhoeae
PTMRLLCRRPSFCRIRCVRTYGLSNRLQCQTALRAPSCLPASVFRRPFPCRKILTCAKH

SEQ ID NO: 8640 - protein, 7 aa, Neisseria gonorrhoeae
KRQKAED

SEQ ID NO: 8641 - protein, 53 aa, Neisseria gonorrhoeae
HRYAKQNGFLPECRRGFATDRCRAARPPPLAVGKAAVYAQVGKLRLRLQVKLH

SEQ ID NO: 8642 - protein, 43 aa, Neisseria gonorrhoeae
RINLLRHFLLKFIKHIFRNSKLLYYLFPNPFFIFFPSLGSCFV

SEQ ID NO: 8643 - protein, 7 aa, Neisseria gonorrhoeae
LLFNCLL

SEQ ID NO: 8644 - protein, 39 aa, Neisseria gonorrhoeae
ISSVIICNIFLNNRHIIDGEDAAIVVFTRNIDFVIQGFR

SEQ ID NO: 8645 - protein, 19 aa, Neisseria gonorrhoeae
FLIGFTAGEIMENTVCRLV

SEQ ID NO: 8646 - protein, 28 aa, Neisseria gonorrhoeae
KIGSIANICRTSIRTGLITESTEAIKRH

SEQ ID NO: 8647 - protein, 6 aa, Neisseria gonorrhoeae
PCICIS

SEQ ID NO: 8648 - protein, 21 aa, Neisseria gonorrhoeae
INVNKNNNINQHVATLFFILC

SEQ ID NO: 8649 - protein, 5 aa, Neisseria gonorrhoeae
RATYH

SEQ ID NO: 8650 - protein, 14 aa, Neisseria gonorrhoeae
IEFDGFEHFASVLR

SEQ ID NO: 8651 - protein, 40 aa, Neisseria gonorrhoeae
GFIRFVYPPDFITFPKRFACTIPLFGRVWAMMFSWFKLFH

SEQ ID NO: 8652 - protein, 14 aa, Neisseria gonorrhoeae
SGFRRHLPCGYPLR

SEQ ID NO: 8653 - protein, 87 aa, Neisseria gonorrhoeae
CTNVYATPLLLTRRSVRSASLQCVRSISGKNASPSTDKSTSVIRKSVANGIACPYICAPPIMTASSAPAHNANATSKLATVSAPAAQ

SEQ ID NO: 8654 - protein, 34 aa, Neisseria gonorrhoeae
SACRLMTMFLRPGRGLTGRDSHVFRPIMTGLPKV

SEQ ID NO: 8655 - protein, 39 aa, Neisseria gonorrhoeae
ALKNAKSSGMCQGIALPAPMHRFSAHAAIMVILSIFSPQ

SEQ ID NO: 8656 - protein, 143 aa, Neisseria gonorrhoeae
WHRLSVYLRAAHNDGFFRAGAQCQCHLQTCHRFRACRAIIRLPADDDVPPSGQGFDGQGFPRFPPHNDGFAQGIGFEKCEIFGDVPRHSIARPDAQVFRTRRNYGYFEHIFSTKMPSERFRRHFMTFCVKNLNLRAPYVLCSH

SEQ ID NO: 8657 - protein, 14 aa, Neisseria gonorrhoeae
LLEKRFNWNAGISH

SEQ ID NO: 8658 - protein, 26 aa, Neisseria gonorrhoeae
NTFFQARPYQTPTGCLPPFVQPLLHQ

SEQ ID NO: 8659 - protein, 13 aa, Neisseria gonorrhoeae
NPYFDKAYCFVVS

SEQ ID NO: 8660 - protein, 12 aa, Neisseria gonorrhoeae
SCLLCFRIKSIQ

SEQ ID NO: 8661 - protein, 15 aa, Neisseria gonorrhoeae
RSMRRYSTSQIKISC

SEQ ID NO: 8662 - protein, 8 aa, Neisseria gonorrhoeae
KQQTCFHL

SEQ ID NO: 8663 - protein, 22 aa, Neisseria gonorrhoeae
SFGGGKRDRTDDPLLAKQVLYQ

SEQ ID NO: 8664 - protein, 75 aa, Neisseria gonorrhoeae
QYAEYGFMGKCHGFAEYGFGKECAADDGIGQQDETCPHGLEHEFFQTEQRRQESCELGEVSAVQAPVQQQAQNGQ

SEQ ID NO: 8665 - protein, 11 aa, Neisseria gonorrhoeae
CCDAEQPVCKQ

SEQ ID NO: 8666 - protein, 24 aa, Neisseria gonorrhoeae
CADMQHKGKVGNFISREFSRENQT

SEQ ID NO: 8667 - protein, 105 aa, Neisseria gonorrhoeae
QQHQCGARIQQQLHSAQRIKKAAGKINKQHHPNNQAAGIPEAHNDDFVLNDRHQQCRAVDGQCRAQNRQFRLPRVIPAAPLLLAVPCKCTQSCVNRRQKDENCRH

SEQ ID NO: 8668 - protein, 70 aa, Neisseria gonorrhoeae
NIKEKIMNRRQFLGSAAAVSLASAASFARAHGHADYHHHHDMQPAAASAYTAVRQTAAHCLDAGQVCLTH

SEQ ID NO: 8669 - protein, 4 aa, Neisseria gonorrhoeae
GRNI

SEQ ID NO: 8670 - protein, 11 aa, Neisseria gonorrhoeae
HRRIGHIQADI

SEQ ID NO: 8671 - protein, 7 aa, Neisseria gonorrhoeae
RNGHGRQ

SEQ ID NO: 8672 - protein, 18 aa, Neisseria gonorrhoeae
RINGTAAFGSLLQGLTAH

SEQ ID NO: 8673 - protein, 53 aa, Neisseria gonorrhoeae
NTGKQQQPAGRTAAHFNGEGEDFRRTVQQKQVGGYDTQNRKQNRLDTVAAIGH

SEQ ID NO: 8674 - protein, 114 aa, Neisseria gonorrhoeae; identical to SEQ ID NO: 124

SEQ ID NO: 8675 - protein, 15 aa, Neisseria gonorrhoeae
AARRFGAALPETAAP

SEQ ID NO: 8676 - protein, 18 aa, Neisseria gonorrhoeae
REHGRGRAAVGPEGGRYV

SEQ ID NO: 8677 - protein, 20 aa, Neisseria gonorrhoeae
RLQGAARRAGTGVGRGLSCQ

SEQ ID NO: 8678 - protein, 23 aa, Neisseria gonorrhoeae
YNFSTQENMDTLFSLKVFRQVVQ

SEQ ID NO: 8679 - protein, 141 aa, Neisseria gonorrhoeae
CIVCKNIYRFDGGYPLDGFPESGFEPGYQEGLRFKSRHGLAAHPQIIELGNENSFGFFNFIPVFSAQRVVCQLLIHPNQTLRIEGQDFSFPPFPAADIIQKPPQVSGVRVAEGQDGFRKIIFRSNGRAGQRAEVFLFQYPS

SEQ ID NO: 8680 - protein, 75 aa, Neisseria gonorrhoeae
IQVVTDKHQGRGEIKAEKCLFEGHLPFSKRLFNQIIAQQGKSGRQRGNRRYGRQSELFVACNVMGEGNKNPMVQV

SEQ ID NO: 8681 - protein, 63 aa, Neisseria gonorrhoeae
GIRDFADKYDGACRQDAGRKCPVLHTPDKQRRQQAGKEQGYSRDKRIVFVDHEQADKQCAETE

SEQ ID NO: 8682 - protein, 55 aa, Neisseria gonorrhoeae
KQLPFSIFCLPSAVLRLPVNRQQRTHQQLGKPQCRKVISIGLVEDVGIKPGRQKR

SEQ ID NO: 8683 - protein, 16 aa, Neisseria gonorrhoeae
CGQNQKQDDADITQHP

SEQ ID NO: 8684 - protein, 143 aa, Neisseria gonorrhoeae
FGFFVTEYQQKRIQEVILFLYRQRPDMQYGVLVGTQIEIPQSEPQINIGQKNRRKLYGFPHLVEIFVKEDLRSNHRSQGHGRNKSRINPLNPAGIKIPERKRTVLYFRKNDVGNEESRDDKENVHPQESSGQPAVIQVENNDG

SEQ ID NO: 8685 - protein, 19 aa, Neisseria gonorrhoeae
HGDGPQSVNFRPVSDSLHQ

SEQ ID NO: 8686 - protein, 50 aa, Neisseria gonorrhoeae
DGQFFRQKAQYGVCHAEVALGVFKVDGVDFVRHGGRADFARFDFLFEITQ

SEQ ID NO: 8687 - protein, 204 aa, Neisseria gonorrhoeae
NITPNVAAEVDENRVDAAEGLEKLRHIVVRLDLDGVGVEGQTEADFDEVAAVCFPIHIGIGGHVGVVVADRAVDFAEEFLRLKDFELALQAVHDIGGFFAQSGRCGGLAVGAAHHRDGGKVVRHSGEFADDFGKFGQDDGFARLLQHQGVGQVVDVFAGAGEVDELAHGGDFRHFGKTFFQPIFDGFDIMIGRGFDGFDGGRVF

SEQ ID NO: 8688 - protein, 33 aa, Neisseria gonorrhoeae
KVFDDFVDFGKRFGTEGRHFGNLRLGGQGFEPV

SEQ ID NO: 8689 - protein, 12 aa, Neisseria gonorrhoeae
FDFDARLHQSVL

SEQ ID NO: 8690 - protein, 15 aa, Neisseria gonorrhoeae
KNRAQCFNGLGITAV

SEQ ID NO: 8691 - protein, 21 aa, Neisseria gonorrhoeae
GGKRGDGVDHIGILFGKDIKN

SEQ ID NO: 8692 - protein, 10 aa, Neisseria gonorrhoeae
SAKIARLSFH

SEQ ID NO: 8693 - protein, 55 aa, Neisseria gonorrhoeae
KADTALLLCGCGFFLRRGGSFDRFGGRGFCLLRCGVDIGCCQQCGGNHQGFDFHH

SEQ ID NO: 8694 - protein, 756 aa, Neisseria gonorrhoeae
KKDGVFVGVFAGNVALGVHARAPAAATAFVFCTGKHFYRFFGFKTVVVADDGRQVARQRPLCGQVELAEFVVKIGTVRLQVDFFVAPVFVAGVQHFSGGGAVACADGVMFGAFVVLVVVDAAVEGETPAYAAGGECHPVGTAARIFADAAVKHHRIILEIEFLTDTGAETLLPRRAVQNTALHGGGKAVGGVDAVVAVIEVFAEKLPVAEAAFRRIEIGQVVLRFGRNIVVEQARLDGLHDSAAEQARIAFEGCAAVDIDNGQNAPDAAGCFAAETVEAVISGVQPEFGADVAPAVAEIPFDTGIHDQSAAVLAAVVAEAGKLCGHADLRPACVFMPIGRKAGHDGVRFVFVAALVCQRLVFLNRKAGIQAASRRPAAIIQPYAAVEVDVAGDFFAAVKVAVVAAVGDLVEIDTRLKRVGNVVPVLPFCLIAVVPAAFLIVRQPGQVGLSAVIGTQVTDLSVKRRAAFADNAGGESGIEVGGKVEIIGDGKGNAVRTGRYGRDEQSAFAVAVKREVRPRRIEKGNAAEHEGGVFGNAYAFSPIGFDRGGLDIPAGISGGTGVELGFRQFVTPFAQHFGGAADALQPPSALFGFHTDVVRFAGLLIEIVGQGFAPNQRTVLLEGEPVAYGNGVARLVVIRPIGIEDCAVPFDDNASFRAHLNLRLSFHPVGNNARIVFGDGCFAAALDGGFGSLGAAAFVTAKQAGRTEGQIGSLCGFGRALRTAFCDTPVRLFRRNGIGGAMRAETEAQCQHQWFE

SEQ ID NO: 8695 - protein, 103 aa, Neisseria gonorrhoeae
IFMPLGQKQRRQAGKRLQFHRVFKIIPNIAQILFGYAVFPSGKHHGIFAFGGFFECLSLFFGYLPPSQLTVHVVAVAPKRGIPLRVFAAQRRGIPNPYISRRH

SEQ ID NO: 8696 - protein, 29 aa, Neisseria gonorrhoeae
GLRRAAARQIGQDSADDFGGIRRVQKLEL

SEQ ID NO: 8697 - protein, 62 aa, Neisseria gonorrhoeae
KLFDMFGIIRSERADHFAQCRRGKPFGIVFGSRQPCETRRQAERTDFVGMARRQIQRDQSAE

SEQ ID NO: 8698 - protein, 87 aa, Neisseria gonorrhoeae
PAENVGRRIDLSGNAVGSCLNIEGLREGRVPVSGQIDGGHRPRCGQARHQIVERVAVRPPTVYQVNFFGSIRHEFSLLLAAHRRRAH

SEQ ID NO: 8699 - protein, 322 aa, Neisseria gonorrhoeae
EGFCGIVAAGGGTGAAGFVKIHDFDHAQVVERANQRHHDGKHRQPYIALFQKRHNNAEFGVKTHQRRNARHREHNQQHQKGKPYAVLVQPCQIADVFALVVPVRQHHQHAEPCRRHQRVGNGVIEARRKADRARHKRQQDETHMRYGGIGEHTFDIGLHDGGKVADQQRGGGKQGKHQRPVMMHGSQPGNEDAESENDGGDFRGSADQGGNRSGRAVIHVGHPHMERYRAEFERNGDDDKHQTQFQQPFVSFFIEGRGEHAGKFQRTGCAVNHRNTVEQQAGCQRAQNKIFQGGFGGKTGIAAQGNQGVKGERQEFQTDIGS

SEQ ID NO: 8700 - protein, 45 aa, Neisseria gonorrhoeae
KMPRAHHHAHAQEGKQRQGVKLAFENTAHLVVGLGIDKQDKRQGI

SEQ ID NO: 8701 - protein, 59 aa, Neisseria gonorrhoeae
NHFCQTRHTVRNIHPVERRRAALFPHGKLHRRRNRHRCQRAVMRPTAFVITGPQVRRQQ

SEQ ID NO: 8702 - protein, 14 aa, Neisseria gonorrhoeae
HQQRQQRDFGQCGH

SEQ ID NO: 8703 - protein, 162 aa, Neisseria gonorrhoeae
TGFVPNRPHRNRLFAAELLQRRGNVFAQFDHPCAVINHSGNVGQSVAAYGQGGLRRGQRFAVGDFAGQTRVQCQCVDVGDGFGQFVGGDAFDGFDVEALVYHTVRGGVAYAFAPDKRGNRPAQSGTVVGGGFGSNLVAACFADLRDNLFKYPVLEFDGFGFA

SEQ ID NO: 8704 - protein, 14 aa, Neisseria gonorrhoeae
TEDDSVEIRLVDEK

SEQ ID NO: 8705 - protein, 18 aa, Neisseria gonorrhoeae
FLVAFFCCNAGFLNALVF

SEQ ID NO: 8706 - protein, 96 aa, Neisseria gonorrhoeae
WQLTGILNLKNFRNIAKAKPRFSPQDLSTDILRFERKYRNGVLHFKLHESLKASLRPRRGRRTFQVGRLLVETAHPEMSRKSARWLFQQGCMFNIH

SEQ ID NO: 8707 - protein, 132 aa, Neisseria gonorrhoeae
QEERYKQKLLYAQRNLFDVLEIDNREAACLIVQVNHGNQHQERTRQRIEEQLDRRIDAARAAPYTDNQVQRNQHTLEEHIKQNRILRGKRAVNQTRHHQECRHILRRTFLNDFPTGQYHQQRNKRIQDDKEH

SEQ ID NO: 8708 - protein, 79 aa, Neisseria gonorrhoeae
NTVHAQCVVDFQKRNPLVELGKLIAAAQTVETGKQGQRYQETGKRSHEGKHTRQRRTAVFTGRQNQHACGDGYPYCQAE

SEQ ID NO: 8709 - protein, 7 aa, Neisseria gonorrhoeae
VVGKHSG

SEQ ID NO: 8710 - protein, 38 aa, Neisseria gonorrhoeae
PVVKIKNIVVWVGLYRQRFRKSSERRNEYSPPFFTYSQ

SEQ ID NO: 8711 - protein, 7 aa, Neisseria gonorrhoeae
FSQIFYF

SEQ ID NO: 8712 - protein, 19 aa, Neisseria gonorrhoeae
INIFGAFACSFCRLKFIFF

SEQ ID NO: 8713 - protein, 7 aa, Neisseria gonorrhoeae
KFFNGSI

SEQ ID NO: 8714 - protein, 16 aa, Neisseria gonorrhoeae
NRISIWIFLTKHFRKN

SEQ ID NO: 8715 - protein, 9 aa, Neisseria gonorrhoeae
TTSGNPTFF

SEQ ID NO: 8716 - protein, 19 aa, Neisseria gonorrhoeae
PINLLGNHIISLSKWSIKN

SEQ ID NO: 8717 - protein, 5 aa, Neisseria gonorrhoeae
LDGNA

SEQ ID NO: 8718 - protein, 4 aa, Neisseria gonorrhoeae
FSKI

SEQ ID NO: 8719 - protein, 27 aa, Neisseria gonorrhoeae
RLTRPFPRFILKTIAYPFSFIFAFPRP

SEQ ID NO: 8720 - protein, 23 aa, Neisseria gonorrhoeae
FIKFPIKIIIVYFSCCTLLNKIF

SEQ ID NO: 8721 - protein, 28 aa, Neisseria gonorrhoeae
LITHSLMVSHLLSPCRNQFLIIIWHLHK

SEQ ID NO: 8722 - protein, 4 aa, Neisseria gonorrhoeae
LIHH

SEQ ID NO: 8723 - protein, 4 aa, Neisseria gonorrhoeae
LSNS

SEQ ID NO: 8724 - protein, 58 aa, Neisseria gonorrhoeae
FLIVNFSFLILLKPIFRYRDRFHRNFISPRFDFYKILLGNFSQNICFIIAIKRSMSQI

SEQ ID NO: 8725 - protein, 60 aa, Neisseria gonorrhoeae
SIIFILIILPKYSFRMKTLNALSYHQCEFQMGRKPFQHFPNSLFFRQSEILSKNKFKLLQ

SEQ ID NO: 8726 - protein, 459 aa, Neisseria gonorrhoeae
MVFGQAAPFFFAVEHHKVLAERVKRGNEHAGEDGKIGNAAARQGAVFHCFDNRIFGVEAGEERRTDQRQIADQHSQPSNRHVFFQVAHMAHILIVVHTDNRTARRQEQQGFKEGVGHDVEHRHRIGGRAQSHGHVAQLRQGRIRNHTFDVVLNHTQEAHKQGGNRADYHNDRQRGAAHLINRRHTRHHKQTGGNHRRGVNQCRNRSRAFHRIRQPDVQRELCRFTHRTDKQEQTGYGNQRPFHAGEKLDSGILYVGQIGEYVLITQAAAEIGKHQADTEQKAEVADTVDQKGFQVGKCRARTFEIETDQEIRHQAHRFPTEEELDEVVAHNQHQHAESKQRNIAEEALVADFFIVHITDGIDMHHQRHARYHDHHHRRHRIDQEADGKIQAAHCQPGIDVFVKLGTAAIEESPQHISRQHGRYSDTEYRNRMRAGTPDFVAEQTRNQRACQRNKGNYQI

SEQ ID NO: 8727 - protein, 5 aa, Neisseria gonorrhoeae
SHIVH

SEQ ID NO: 8728 - protein, 211 aa, Neisseria gonorrhoeae
NFAFFGRFDLRFDRFHFHQTHTALIGAYFNLVGWIHTFRIGGFAVNQCNRGHHAQQQQYRRQFKRQQVVGINTAAQIADIVVIGRNVFHQTKCGQVGFRVDQNQDQGNRQQRTDHTGNRRVPPETGAHFLDVDIQHHHDEQEQHHYGADVNHHQRHAQKLRLHQHPNHRAHAEGQHQMQSGMDRVFGGNGTNRTVQNDGGKDIEQNHGKSH

SEQ ID NO: 8729 - protein, 8 aa, Neisseria gonorrhoeae
VSHIMFPQ

SEQ ID NO: 8730 - protein, 255 aa, Neisseria gonorrhoeae
NHPHAQNHDVGEADRNQHFPAQTHDLVVAVAWEGCTNPQIPVQHRRHFHEHPECGRRTDNAPALRERRQPAAEEHQRCQRGNQNHENVFGKEEQRECKAGVFDVVSGNDFRLALCHVKRCAVGFGNGGNQIDDEDWEQRQPVPREHRTARDAFCLRGNDVGEVHAARYHHNAHQRGTHGNLVGNALRGSTHCTQERIFGVGSPARDNHAVNRQRGNHQDVQKADIDIGQHPFFVKRNHRPRRERRGERHNRADVE

SEQ ID NO: 8731 - protein, 93 aa, Neisseria gonorrhoeae
QLRTGYLFKQEFEHVGKRLNQTPRAGYVRADAKLHKADDFTFEIRQVGNGQNQRNQDNHDFDDDGYHQAYGDAQIAQTERCGKEVLEPFLHNQ

SEQ ID NO: 8732 - protein, 55 aa, Neisseria gonorrhoeae
GRLNALPCPCAAVVQFGRQTFRIQRVFQNRSGIVVFKTFQVKQVAQYAQHFPHRT

SEQ ID NO: 8733 - protein, 22 aa, Neisseria gonorrhoeae
IAEALYHAVERLQTAFHIDEAA

SEQ ID NO: 8734 - protein, 220 aa, Neisseria gonorrhoeae
CFGKRRNRQQYVAHVQQRFADKRRKRHHAFRLFQRGYGFCTVNRIDFRLDVEQQDCLFRRVCHFGNALARVHTQYVRTDAVGGLRQNAQHCAGRVRQLLRGGINGGVIRMVLHFRTQNHRCFFSVFQAGGNGMFRIGRQVFQTACPLVGMCGFLRQKRHKQFFFTAGQYAQGHTVFGGAAQAGGQERLFFAQVRTDYQYGIVVSQRFNTLSQPLRTFKAV

SEQ ID NO: 8735 - protein, 350 aa, Neisseria gonorrhoeae
KTFVLLAQTGCKVFNTQAVGKFFGQIQLFNRIHRISPNADLVLVAVFGDTFNRAADIFQRGFPIHVHPLATLFDFRIFQTAFVIQAFVGKTVAVGQPAFVDGFVFQRQHAADGMVFGLYNQVAAQSVVCGNGFAAVQFPSTRVEAERFAGQCADGTQIDDVARQLGFHRFADKGHDFGVFTTIHHRNFLQTGDFFGETYAAGTVDTAAHFLGGNQRTHVLADDGTFFFGITAGGFAVAHRQILQLAFAALVAGRTIKRMVDEQELHHAFLRLSGFCRMRTHNHAVRYRRGTGRQRFGGFFHIHQTHTAVGGNRELFVVTEMRNISTELVRGFNYRRALLHRYLFAVDFDL

SEQ ID NO: 8736 - protein, 33 aa, Neisseria gonorrhoeae
LFNSTLIVFICRLKLFTPINYIYIAMQYPTASQ

SEQ ID NO: 8737 - protein, 11 aa, Neisseria gonorrhoeae
ISPNLVFIITR

SEQ ID NO: 8738 - protein, 16 aa, Neisseria gonorrhoeae
IKTNPLTFMIKYCNKI

SEQ ID NO: 8739 - protein, 9 aa, Neisseria gonorrhoeae
AVSISFKKD

SEQ ID NO: 8740 - protein, 26 aa, Neisseria gonorrhoeae
KFRKFPTNLIKKRIECRTLTFVGCTV

SEQ ID NO: 8741 - protein, 13 aa, Neisseria gonorrhoeae
NKNFSFHHYHPPH

SEQ ID NO: 8742 - protein, 92 aa, Neisseria gonorrhoeae
AFEGFDHAHVFVHHDNRAGTEHRAGFGNRVIVHIGLHHNVGRQYGGGRTAGNNGFEFFTAAHTARHFQDFGKRRAQRHFIVARTLDMAGNTK

SEQ ID NO: 8743 - protein, 239 aa, Neisseria gonorrhoeae
FGTACIRNTFIGKRLSAVTDNKRDGGERFGIVDGGRFAVQAERGGERRFEARLAFFAFQRFKQCGFFAANICAVAVVGEEFEFKIRTQNIFTQKACGTRLLQSGFKALITFENFAVDIVVAGFRAHRVTGNDHAFNQGMRIEHDDVAVFKCTRLAFVGVANHIFFARERTGHKAPFQTGREARTAAPAQAGGFDFVNHIGLRDVFGQDFTQGGIAAAFDVFVQCPAIGIGGIHLVKNHA

SEQ ID NO: 8744 - protein, 5 aa, Neisseria gonorrhoeae
LVNSH

SEQ ID NO: 8745 - protein, 4 aa, Neisseria gonorrhoeae
GFCG

SEQ ID NO: 8746 - protein, 203 aa, Neisseria gonorrhoeae
NDVNAELAFRVFDSGVGLALGNVHTLGKEFEMVNQVFHTCFHFGTFGRSEFVVCGNDRAGIDAQPVGALFDDAYGLAHFFHTAEVTVVAVAVDADGDVEIHFVVHFVGLCLTHVPFHAGTAKHHTGKAFLHGALGRDNADADGTLFPDAVVGQEGFECVDIFGEAFAEGIDKVKHRAFAGFVELLQYFGIAKFAALVFGHKAG

SEQ ID NO: 8747 - protein, 141 aa, Neisseria gonorrhoeae
VAVNAAGTEVGGVHTCAGHGFVQVHQLFAVAEGVEDGGHRADVEGVRTDAHQVIEDARYFGEHHADVLGADRHIDTGKFFYRQAIRLLVDHHGNVVQTVHIGQGLQIGFGFRQFFGAPVQEADMRIGTDDLFAVQLQNHTQ

SEQ ID NO: 8748 - protein, 58 aa, Neisseria gonorrhoeae
NPDAYADALIVFNGKQLTDNGKAFALPCFVFVSAVIDAAQVNQKLEMQIFMVVQCGHD

SEQ ID NO: 8749 - protein, 15 aa, Neisseria gonorrhoeae
NIVLGQTLDGNLAQS

SEQ ID NO: 8750 - protein, 16 aa, Neisseria gonorrhoeae
NDFACLIAKHADDGLV

SEQ ID NO: 8751 - protein, 6 aa, Neisseria gonorrhoeae
VLNACH

SEQ ID NO: 8752 - protein, 33 aa, Neisseria gonorrhoeae
TGTHMVQHRIRAGGDETFFQNAFYSHSSAPFFH

SEQ ID NO: 8753 - protein, 103 aa, Neisseria gonorrhoeae
KFRTQQVSGIGTPVPSRIHQNQVEFFIRMATQPFPTVIQYNFNTFVLQKRCDLRLVRDKATVCRIDFRNDHRLHFRNGRQDARPRTCTQSNDENAAYAGLQGG

SEQ ID NO: 8754 - protein, 61 aa, Neisseria gonorrhoeae
QIGTFDAVDTIEYIGIVCAVVYIRPINNLITISMVNRNNAVFVFNQPIRTASNILKDRIRQ

SEQ ID NO: 8755 - protein, 7 aa, Neisseria gonorrhoeae
EHEDAEH

SEQ ID NO: 8756 - protein, 157 aa, Neisseria gonorrhoeae
GNCYRHCIQSETFLEQCTKQRDSSRNQTDEQVNLLGGQEIKYHKADKDRTQCTAGNVGEINIGNLSSGFVAIRTHMVYKWENQPPDDGRQGNEDTGVVDEAGKTRQQPRSTQNQKIGNTRPQEALPDKGNINKAAAANPFAKIRADGDTGQKTGKSK

SEQ ID NO: 8757 - protein, 24 aa, Neisseria gonorrhoeae
KCLRHGLCCERKHPYPQDFYTQAQ

SEQ ID NO: 8758 - protein, 32 aa, Neisseria gonorrhoeae
SAKERKHINQTSIRFSVHHIHPFCNAAILKQQ

SEQ ID NO: 8759 - protein, 41 aa, Neisseria gonorrhoeae
SSNQKVKAGCQRNGLGEGKKDVEKFGGGKRSECRTQSVEKI

SEQ ID NO: 8760 - protein, 32 aa, Neisseria gonorrhoeae
GTDRLANIMYFPVKKTGQQGQGRAHHKGRKQQ

SEQ ID NO: 8761 - protein, 14 aa, Neisseria gonorrhoeae
EEIGSSDDGQISLN

SEQ ID NO: 8762 - protein, 30 aa, Neisseria gonorrhoeae
KMPQAGNQTLAYQTEQTDGYFSDAKQGDDT

SEQ ID NO: 8763 - protein, 37 aa, Neisseria gonorrhoeae
RKTVSNASAEIRTYTQADHKYRNNDSNRTQIDTYVAE

SEQ ID NO: 8764 - protein, 38 aa, Neisseria gonorrhoeae
KPLPADLVNQGAEARGEKHQRQSFQGFTCGRIHIFYFQ

SEQ ID NO: 8765 - protein, 15 aa, Neisseria gonorrhoeae
EITALLKLQAGKINS

SEQ ID NO: 8766 - protein, 15 aa, Neisseria gonorrhoeae
ARKRRITVQTAVRLH

SEQ ID NO: 8767 - protein, 15 aa, Neisseria gonorrhoeae
FKFMFQLFFYPFGEV

SEQ ID NO: 8768 - protein, 6 aa, Neisseria gonorrhoeae
IIGKFQ

SEQ ID NO: 8769 - protein, 8 aa, Neisseria gonorrhoeae
ISFFFSVK

SEQ ID NO: 8770 - protein, 31 aa, Neisseria gonorrhoeae
NALRFVAFFGLFGWVHSSPLLKIIVDTFYSI

SEQ ID NO: 8771 - protein, 14 aa, Neisseria gonorrhoeae
IRLKMLFGNAVKLA

SEQ ID NO: 8772 - protein, 75 aa, Neisseria gonorrhoeae
MTFCPVPKVPNSINMVLSFGKMCAVIDTEMAKFACIQYIIATITIRINNAVRLCCCSCSYACDKQFNEFILFIPA

SEQ ID NO: 8773 - protein, 5 aa, Neisseria gonorrhoeae
TAFSH

SEQ ID NO: 8774 - protein, 52 aa, Neisseria gonorrhoeae
AGMTVRVFLTIHRAVATVFSTPSGKNTKTQIKPSEYRFRRYRLRQNNHASGH

SEQ ID NO: 8775 - protein, 19 aa, Neisseria gonorrhoeae
NGFFRFCVPDSHFRGNDGM

SEQ ID NO: 8776 - protein, 19 aa, Neisseria gonorrhoeae
VRGNDGGGCGKIALPVFRQ

SEQ ID NO: 8777 - protein, 11 aa, Neisseria gonorrhoeae
ILRSGFPLSWE

SEQ ID NO: 8778 - protein, 7 aa, Neisseria gonorrhoeae
RNVGSRE

SEQ ID NO: 8779 - protein, 69 aa, Neisseria gonorrhoeae
RRRLRQNCPSRFQTTICLVLATVFCRRSDSRIRHFQQRFFGNDKRVKCFFCRIRISGLHFKFTSLPISQ

SEQ ID NO: 8780 - protein, 5 aa, Neisseria gonorrhoeae
PIGKN

SEQ ID NO: 8781 - protein, 15 aa, Neisseria gonorrhoeae
FYLHLICTFFINIIQ

SEQ ID NO: 8782 - protein, 95 aa, Neisseria gonorrhoeae
NVFGQGFKVAVFGFELDGGVDEFVKVVEAVLVVAFLGSVVLGQTAVFEDADDDFGQVHLSDLVAQGFNQADEGDDFGGFRAGVAGCLPEGDALFV

SEQ ID NO: 8783 - protein, 432 aa, Neisseria gonorrhoeae
GRLKVFDGARADAARWEVDDTQEGVVVVGIDGEAQVGEGVFDFLAFVKAQAAVDFVGDAAAEQALFDDARLGVAAVEDGDFVQIPAFAFEGFGFIHDEPGFFEVGKGGVVADFVACFGVGAQVFAETFVVVFDNGVGGGEDVADGAVVLFEFDGRVDVEFFHQCGHVADVCAAEAVNALVVVADGKYRCVTARHEFEPGVLQFVGVLKLVDQNVVEAVLVVPAQDFVTLQHFVAAEHEFGEIDHAFALADFVVFGVAPNHAACVRIGRAQDGSAQTGFFLRVDKALQRTRRDDFFGDVEAFEQAFDEGKLVAAVEDLKGRRQACVAVVQAQKAVAQTVERAEPHSADVDGNHCAESGLHLFGGLVGKRYRHNAVYAGLSALQKPCDTRGQHARFAAACACQNEGGLRRPGYGGELFGVQALQQIGGGLVGKH

SEQ ID NO: 8784 - protein, 165 aa, Neisseria gonorrhoeae
GDVAVVVQELRILAGMGKYQILDDKFDVDHAAARVFDVAVGRRMGGEHFFAHFDDFACQGGLVAFGSQHFGADAVECRLNFGCAADEAGAGEGLVFPCPCVFTLVFSKGGDAVREETGVAIRAQAQVGFVEAARAGGGGKPVGQAAGEAAVHVACFGMGIVVKID

SEQ ID NO: 8785 - protein, 95 aa, Neisseria gonorrhoeae
VEVGGVAEFFAAELAVADDGELRGVAVFFGHIRPRARKGGGNDGVGEGGELVREGFYRPQSGEVLDGEAEDLGVLEMAQRVHLRFGIAAAGFDAV

SEQ ID NO: 8786 - protein, 131 aa, Neisseria gonorrhoeae
KGGGECLPIKRGIQKLRADEFVQQNRIFVQIRRHPRALAHNLRQLCQGLRMFVEEGEIGGAEADVFEKIQQPHQRICRVVLLCRRLYKQRHNGVKARLGVCGKAAVFMSVADLFEPCGDGFGIEPVFFQTA

SEQ ID NO: 8787 - protein, 44 aa, Neisseria gonorrhoeae
PFFFVGFFLPCPLPFAIALRLFFRFAQDFVEQLIDFVPMNIEAV

SEQ ID NO: 8788 - protein, 388 aa, Neisseria gonorrhoeae
KSGITVETHAFGEQLPLFGRDRQGLGLPVVPVLQAVFDIAQEAVGGKQGFDVFRRHNAHLGNFLQRFLRAFQLQRAHLAAAYHLENLGDKFNLADAARAEFDVVRHAFFADFAADLAVQVAHRLIRAVIQIFAEHEGAHQRFDVVRIRRDYAAFAPRIAFPFAPLRNQILLQHGFAQYQRARITVRPQPHIDAEHLPVGSNAVQQCNQFLPDFGEKLLIPPFAPAVGVARFGIDENQIDVGRHVQLIAARLAHRHHAQMLRRFGITPDRRAVHVPIIGVGEIQRGIDGKIGKQRNRAGNFVQIADAVYIAHDNLRHHITAQLAQLPRQFFLAFFRADFVPVGKGLETLIRQRLVQHGQENFGLEFAVVELAGEEQGMAAGGVEAVVGH

SEQ ID NO: 8789 - protein, 15 aa, Neisseria gonorrhoeae
KNSGKCRRFPFKPRH

SEQ ID NO: 8790 - protein, 27 aa, Neisseria gonorrhoeae
NSISRTFLPCGIFKKTITLYDFMQLLT

SEQ ID NO: 8791 - protein, 70 aa, Neisseria gonorrhoeae
FLRIFHFQRLMLIAGFNQSLAYCFCCFSHTTPKTHNHVLQSFQINKVVVSVKKQRQFINCRKTKCRLNAG

SEQ ID NO: 8792 - protein, 5 aa, Neisseria gonorrhoeae
RFRRH

SEQ ID NO: 8793 - protein, 24 aa, Neisseria gonorrhoeae
PGNIFFISVGRRNITVFGRHIPDK

SEQ ID NO: 8794 - protein, 31 aa, Neisseria gonorrhoeae
FYFFRIIEIRINFFNFPQRAVKFFLSMEYVI

SEQ ID NO: 8795 - protein, 19 aa, Neisseria gonorrhoeae
EDVQPIFRGITPRFRSQIF

SEQ ID NO: 8796 - protein, 8 aa, Neisseria gonorrhoeae
FKNIGFIG

SEQ ID NO: 8797 - protein, 8 aa, Neisseria gonorrhoeae
LEHAFIMI

SEQ ID NO: 8798 - protein, 35 aa, Neisseria gonorrhoeae
KRHFSGISCHISPTQVFILIPPQNILPRKADFLSG

SEQ ID NO: 8799 - protein, 4 aa, Neisseria gonorrhoeae
IKVH

SEQ ID NO: 8800 - protein, 9 aa, Neisseria gonorrhoeae
TAKRAFRRH

SEQ ID NO: 8801 - protein, 37 aa, Neisseria gonorrhoeae
FVDGGVGSDDAVHFDGFDDAGDVFDLCFIQIGGDFDG

SEQ ID NO: 8802 - protein, 57 aa, Neisseria gonorrhoeae
RDIFAVGGGKLRLFVFQGFEQCAQFAAALQRAEVFGVGRGNVDGNVACVRVGFFEAD

SEQ ID NO: 8803 - protein, 175 aa, Neisseria gonorrhoeae
IIIGGVLDGRNRVFADVDAQYALIFAFFNIAYHRVDAVVVKTHSVDDALVFGNAEEARLRVAGLRVARNRADFEEAETERAQSVDVFTVFVETCGKPDRVGQIHTHQFYRFGTVVGYGNQAQFINRVERVEREVVGFFGIECKQDAAGKWIHDRAFCFRWKCRHFNRNPAKHTAH

SEQ ID NO: 8804 - protein, 14 aa, Neisseria gonorrhoeae
PVVARHNSLCCTAQ

SEQ ID NO: 8805 - protein, 82 aa, Neisseria gonorrhoeae
QLRRSQVKPLRLFCRRGLGKRRPPPACRVGIKRKLRHQQHRAADIFQRQVQLARFVFKHAQMCDFVGDIACIFFCVAMRYTE

SEQ ID NO: 8806 - protein, 33 aa, Neisseria gonorrhoeae
HDKPAVDFAAGFRAGFGHDIHLCTYRFLYDRTH

SEQ ID NO: 8807 - protein, 4 aa, Neisseria gonorrhoeae
QNAV

SEQ ID NO: 8808 - protein, 31 aa, Neisseria gonorrhoeae
NLQTAFSKHPARCRTARHANQPYQTANNRRD

SEQ ID NO: 8809 - protein, 12 aa, Neisseria gonorrhoeae
TAIQISPFSLRV

SEQ ID NO: 8810 - protein, 219 aa, Neisseria gonorrhoeae
GRVRLRVCRCRFGAGVFYSRRGLAAVAVNAVEGVSDDMQGGGFGSTFARSFYLQYQRFGHIGGGHACRIEFFQCGQGLFQHCFIQHPLQGRMVQDVFDAVGQVALLVKEIDKDVDAGGFLVGKGVFARLRVQVLLEIFFAGDVGQHIFAFVSADLTRGRGVMAEFGIGKFIRFFAFEQGVVRRPVFDLAFKFDTRHLQYAQRLLQPLVELLGLFELYSD

SEQ ID NO: 8811 - protein, 42 aa, Neisseria gonorrhoeae
GNDNAVKIVIFSLSAQKNAAKRHCIINGFNERVRIPSDNKKQ

SEQ ID NO: 8812 - protein, 30 aa, Neisseria gonorrhoeae
FLQKENKMSIQEIYYNQETGYEYAFRQIVL

SEQ ID NO: 8813 - protein, 28 aa, Neisseria gonorrhoeae
AVCPPFDQPEKRNKSDDYLQMPRNPSDH

SEQ ID NO: 8814 - protein, 20 aa, Neisseria gonorrhoeae
GGIMWMEIEEILSRAVRYRK

SEQ ID NO: 8815 - protein, 17 aa, Neisseria gonorrhoeae
PGIKMPSETSFDRFRRH

SEQ ID NO: 8816 - protein, 18 aa, Neisseria gonorrhoeae
CRKIKCRLKLYRFQTAFC

SEQ ID NO: 8817 - protein, 7 aa, Neisseria gonorrhoeae
FSIGIIV

SEQ ID NO: 8818 - protein, 6 aa, Neisseria gonorrhoeae
NIDFPQ

SEQ ID NO: 8819 - protein, 26 aa, Neisseria gonorrhoeae
RCDRYTEEIIGRTGLPAGLNNDFNLP

SEQ ID NO: 8820 - protein, 7 aa, Neisseria gonorrhoeae
GIHDVFQ

SEQ ID NO: 8821 - protein, 117 aa, Neisseria gonorrhoeae
NLLPVFQTAFVAFTVNHHIEEGELHLPDEEHTALEVFGGEHFVEEFFRQGLAGFFVGGHLCQYIVFPNEVFHKLAGQFDRVPFYAVDAGHAQFVHLGKQVVQSVAGFVEEGEDFVVA

SEQ ID NO: 8822 - protein, 161 aa, Neisseria gonorrhoeae
TRFFAADGRGEVADEVGGGQLQRAVGKAAAAFVVVHPRAAAFAFACVQIHINAADGFAVLLQFKIAHVFVPDGNGFFGESDAVEFFDLGEQACQNFADGEVFFDFGFAECVFGFAQFFAGVAQVPRLRVGETEVFAGEGFDFGEVFFGVGFGAAGEVVQEV

SEQ ID NO: 8823 - protein, 46 aa, Neisseria gonorrhoeae
NLFGRVRHFGCQRQFGVIFKAEQFGGFQCVFERAVDVGGVVEFAVV

SEQ ID NO: 8824 - protein, 75 aa, Neisseria gonorrhoeae
KFAGTGNVGAVDLFAQFAVAGVLDNGKVVRNLQADFVTCFAFALRGGGKHGERVFGNAGKRCGIVKVNAERVGRV

SEQ ID NO: 8825 - protein, 183 aa, Neisseria gonorrhoeae
DVLGEFGGKLRAFGLQFCQFCLPFGRQFRAAQYEIAQVVIELGFLCGGKRCKFGGIFDGFEAVVQFDVLSDFGEEDGDFRHQFVIDGAQFGRVDDGVEMGHDAPNPADAFGDAGQTLDGVRPAGVRLRFDGGDLSARFGDGGLDGGFDVFGFDLIKTGFFAQVEQCVVNHKMGFLCVLCFRRH

SEQ ID NO: 8826 - protein, 20 aa, Neisseria gonorrhoeae
QAVLYAQKFVHNRLLDFQPL

SEQ ID NO: 8827 - protein, 149 aa, Neisseria gonorrhoeae
NGGGEADDDAVCLVVVRYAGNARPGGGRDKQFFRLHVFQIPLNGGDVGRAQGLEYGFQTAYGFIRIQMDGNGDFDRMDDIVAQNIVAAHGVAQQQAVGERNGGSRKLSDQGVRTDLHHQRVQQIDVDHAPAQAVDFDIVADRVLLGGRP

SEQ ID NO: 8828 - protein, 117 aa, Neisseria gonorrhoeae
NTARQTHNQFFCRHDDRRRHRKHRQSQRLNLRRPDKCQRKQHQKQRYIAAGNQKPPLAFDAEIRMPSEVDIQQKGARQQQSRDRRHGFGRLRAYRDGIGPSVQHIPYFHFRAPVRKV

SEQ ID NO: 8829 - protein, 24 aa, Neisseria gonorrhoeae
GVDFSGKKTLLPLCRQIPRPYRPQ

SEQ ID NO: 8830 - protein, 11 aa, Neisseria gonorrhoeae
AKARQRRTGFC

SEQ ID NO: 8831 - protein, 7 aa, Neisseria gonorrhoeae
STIKGLF

SEQ ID NO: 8832 - protein, 73 aa, Neisseria gonorrhoeae
NMQIFECRICLMITVFCLIRLKMPVFRLNQIIFAETLKNLPYLPDRHQDFVVVTEKNILKVRIPNQSLKYRNH

SEQ ID NO: 8833 - protein, 101 aa, Neisseria gonorrhoeae
NVLRFVHIVERNHHHFRPSQTGGFQYFPAFRIAERHRLACTSGYLHACDVQVEREIRNILLGEDASDRLPAPAEADNQHMIRLAHRFHQHAVQIERLHVPA

SEQ ID NO: 8834 - protein, 312 aa, Neisseria gonorrhoeae
LDQAPDQRIAAAQEEGRDNHRQQNRRRRRLFQFWRNHIKLPGNGQHHEAELAALREIQSRFEAVADRMLHFECNGKHNQCLQHQQHCQQHQYLPPAADQCLNVQLHADRDKEEAEQNIAERANVVFDLETVFRFRKQHAGNECAQRHRQTFQLSQISHTQGYQQHIDHKEFGRFAFCHHPEPSRHNFAADEKQQPQRQQHFCKRQTQGRPNISVPSASQRGNQNHQRHDGDVLHQQHAHRHLTVRLPQLRLFRQNPAHNRRGRHRQRARYGKRPIERHARQHQYAHYRQHRNADLQTAQTEHQPPHRPQLGQ

SEQ ID NO: 8835 - protein, 110 aa, Neisseria gonorrhoeae
KLQTDAEHQEHNPDFAQIIRRMAFRNQAEHTGPRQKAHQQVAQHGGNVELAAQDHRNDRHQQNNHNRGKRKFVHGPSEQENTEKCRLKRHTPPYYNKTPRTIRNGRGIQF

SEQ ID NO: 8836 - protein, 4 aa, Neisseria gonorrhoeae
NTPF

SEQ ID NO: 8837 - protein, 5 aa, Neisseria gonorrhoeae
PAPPH

SEQ ID NO: 8838 - protein, 15 aa, Neisseria gonorrhoeae
IFEQRFDRFLTVQTA

SEQ ID NO: 8839 - protein, 51 aa, Neisseria gonorrhoeae
TFKTAADDQNGIMSAAGIARVSFVQMALIADFQHQRIERLQAFADQIDSRH

SEQ ID NO: 8840 - protein, 5 aa, Neisseria gonorrhoeae
ATNRQ

SEQ ID NO: 8841 - protein, 24 aa, Neisseria gonorrhoeae
KFQLYFPANYIYDKTGRKIIPTPY

SEQ ID NO: 8842 - protein, 14 aa, Neisseria gonorrhoeae
CQCTSIIQDFIILL

SEQ ID NO: 8843 - protein, 44 aa, Neisseria gonorrhoeae
FSKLQGIIDIFILVLRSVSIDKFQIAELLEFNFYPVCVIWCRAQ

SEQ ID NO: 8844 - protein, 13 aa, Neisseria gonorrhoeae
SHSGQFCFIWNSS

SEQ ID NO: 8845 - protein, 4 aa, Neisseria gonorrhoeae
ILIV

SEQ ID NO: 8846 - protein, 22 aa, Neisseria gonorrhoeae
CAINHNFSPFFCNTCCFGKIIH

SEQ ID NO: 8847 - protein, 110 aa, Neisseria gonorrhoeae
FRHGLLTQQDIRQADMRHFDFAFHISIGQRRNLVADDHRTLAQRHLQSRRTARYQHRIRRPAHRFRLSVGYRQRQSGKLRPLQNFRQTPLRRLRCGRQQEAGGGIAFQQQ

SEQ ID NO: 8848 - protein, 140 aa, Neisseria gonorrhoeae
CRLKKHRRHIVDFADAAAGQQGEYGDADIRAQSFPRRFTVVFQGHKLCHRMTDKLRTSARIEIKLRLHREQAQHAVDLMHDFAHAFAPPRPNRRTDIMQGRNARPFQLFRHTQIKIGRIDTDKDIRFQRQQIPYQLPAYP

SEQ ID NO: 8849 - protein, 37 aa, Neisseria gonorrhoeae
NFRQPPDHFDKAAHRQPLLIIKALETFRLHQFPADAG

SEQ ID NO: 8850 - protein, 46 aa, Neisseria gonorrhoeae
PCLRATLSDGAYQVRPQQVARRFADTDGNQRAFFINHIRLSPHIVD

SEQ ID NO: 8851 - protein, 120 aa, Neisseria gonorrhoeae
HTEHRMRRLPVLADAYHLFALCAGIFEQGQFDMEIVVRQFAHPQRKVDFFGVVVTDSFVQFDERAAFLRHHQQAARILVQTVDQLQILRLRTGAAQLFDNAETHAAATVYRHTGRLIDHQ

SEQ ID NO: 8852 - protein, 102 aa, Neisseria gonorrhoeae
RVVLIHHLKRTRRYGGTPFRRHFLLRHAHRRNPHRISLRNTAVGFAAFLVQPHLAGADNAVDIALGHALEDFYQIVIKALTRLMFGNPYQADRTFAYFVRFH

SEQ ID NO: 8853 - protein, 9 aa, Neisseria gonorrhoeae
IDFAVSARK

SEQ ID NO: 8854 - protein, 67 aa, Neisseria gonorrhoeae
DGSGAPSPERKPPENTGITITRRSRRPFFRPQRSERGRQTAASIFIAFFIRPFRTRFPGTCIPADFQ

SEQ ID NO: 8855 - protein, 11 aa, Neisseria gonorrhoeae
DFGIFDAEFVF

SEQ ID NO: 8856 - protein, 85 aa, Neisseria gonorrhoeae
VVMQNACDAFNQRLRDGGGNVFQRQVGRYEGDAQAFAGKHHHDLPRAAFFRQIFGVSAEKTCACARGVDDAFVQRRGNDAVENAV

SEQ ID NO: 8857 - protein, 44 aa, Neisseria gonorrhoeae
NACERGVQKLQHIGGVGGIEPPCLNRFGGRDVQHFQPAFSVRAA

SEQ ID NO: 8858 - protein, 67 aa, Neisseria gonorrhoeae
FRIEVAQDDAFAQGFGARAQQVFVAQYRAAAGQACKRQVQTNIGADAGRLAGSNGKNRLFHRVCSKQ

SEQ ID NO: 8859 - protein, 10 aa, Neisseria gonorrhoeae
QSARMGVYKI

SEQ ID NO: 8860 - protein, 7 aa, Neisseria gonorrhoeae
TLLAYRH

SEQ ID NO: 8861 - protein, 93 aa, Neisseria gonorrhoeae
RPAPEQYCRLPHNEAAVAQNNGCAAEYDNQHQSDPLHRIQPFMLPIQESRLNHACNQGNRRSGNHIFGNGISSKKQDDGQKVADKFHIQMRKQ

SEQ ID NO: 8862 - protein, 11 aa, Neisseria gonorrhoeae
KTDRQYTHDPH

SEQ ID NO: 8863 - protein, 7 aa, Neisseria gonorrhoeae
KKMEICH

SEQ ID NO: 8864 - protein, 5 aa, Neisseria gonorrhoeae
LPNRH

SEQ ID NO: 8865 - protein, 28 aa, Neisseria gonorrhoeae
IPACAGMTIFQFSVFDFFCFCGNDDIAD

SEQ ID NO: 8866 - protein, 64 aa, Neisseria gonorrhoeae
DLINAGLQTRLVDAAARRRIALRIQIDHQHAFAARCQRSRQIYRRRRFAHTALLIGDGKDVRTH

SEQ ID NO: 8867 - protein, 19 aa, Neisseria gonorrhoeae
TVQTGNGRETDRETCRKTG

SEQ ID NO: 8868 - protein, 126 aa, Neisseria gonorrhoeae
SKSCRARSKSGKTGRSTRTQTRSVRNSGFGDRTPTRTCTRCKYCRIGNRCRIRPPKKPPLLPSTRRPTKPVTPFPNLLRKQPVKLPPNPLPNLSNRFLPKKKPKADCLTVCSAVRTPCCLPAEARH

SEQ ID NO: 8869 - protein, 29 aa, Neisseria gonorrhoeae
AFGKRSSESFRRPNKKKTHRFRFIQTQGH

SEQ ID NO: 8870 - protein, 23 aa, Neisseria gonorrhoeae
TTIDFRSMAVGSIDDFCRPPHPH

SEQ ID NO: 8871 - protein, 23 aa, Neisseria gonorrhoeae
IIANNFRSLNRPVFGEKTKSIFQ

SEQ ID NO: 8872 - protein, 33 aa, Neisseria gonorrhoeae
QLHPTPPPEQLPKQRRAPRAFAVSLQNLRYNAV

SEQ ID NO: 8873 - protein, 15 aa, Neisseria gonorrhoeae
TFIRIPNPMDTAQKQ

SEQ ID NO: 8874 - protein, 31 aa, Neisseria gonorrhoeae
EYLIPHTVAFRQQQNLLLTQHPGRNGIQFLK

SEQ ID NO: 8875 - protein, 170 aa, Neisseria gonorrhoeae
MPFRDNHEKRFVIQGFGNNARLLKRFGNDNRVNVPAFERLGQSMRVILFQHQRHFRCSTAQRDNQFRQQVWRNRKNQPEFERTLQLVLFFICQMPDKLRLFQYLTRLCNDTFPRLGRNNIVAAPVKQRDGKLFFQFLNGNRQSGLADKTTPRRPAEMTFLGDCDDVPQFG

SEQ ID NO: 8876 - protein, 14 aa, Neisseria gonorrhoeae
NIHIFGQDFHQLFT

SEQ ID NO: 8877 - protein, 35 aa, Neisseria gonorrhoeae
SRQVIRSLTFLGALLGNDDLKAVAGNGCRFLLSTE

SEQ ID NO: 8878 - protein, 4 aa, Neisseria gonorrhoeae
KFDQ

SEQ ID NO: 8879 - protein, 150 aa, Neisseria gonorrhoeae
QMFFNRTALLRLTGFALQNSQNPVGVTHTGNLRIGRYNGFISKIQRHQCTLLNTSRRVANNILKAHFLAGQLLHHFFYALACQSVFIPSLGSRQNKQVFTIFIFNQSLVERRLTLNDIDQVINDTTLATHNEVEVAQTHIKINYRSFISA

SEQ ID NO: 8880 - protein, 19 aa, Neisseria gonorrhoeae
CQTCCNTCTGSRFTDTALA

SEQ ID NO: 8881 - protein, 8 aa, Neisseria gonorrhoeae
SYYNNFCH

SEQ ID NO: 8882 - protein, 46 aa, Neisseria gonorrhoeae
KQRNQCSKIQRLGIIKFLNIQNKWNNTRLLKLLAQFDQHIFQIKQV

SEQ ID NO: 8883 - protein, 28 aa, Neisseria gonorrhoeae
CMQRYRQYVHLCRLYIEGIHYINHHRIF

SEQ ID NO: 8884 - protein, 6 aa, Neisseria gonorrhoeae
CKFTAQ

SEQ ID NO: 8885 - protein, 24 aa, Neisseria gonorrhoeae
RHLLFGRWRYMTKITQQPVCQPIQ

SEQ ID NO: 8886 - protein, 30 aa, Neisseria gonorrhoeae
RLFTQCNQRLYYTAQFLGLRQSCYNSFVSQ

SEQ ID NO: 8887 - protein, 16 aa, Neisseria gonorrhoeae
IRHITQHCSTMTAGTV

SEQ ID NO: 8888 - protein, 9 aa, Neisseria gonorrhoeae
FAIAITMTH

SEQ ID NO: 8889 - protein, 19 aa, Neisseria gonorrhoeae
TYCQFQIIHRMQKNRVDRR

SEQ ID NO: 8890 - protein, 89 aa, Neisseria gonorrhoeae
FFFNLLHRSTLQISKNRHLINQNTCRTAYSFLRINRTVGFDIQNQLIKIRPLLYTCRFNLKANTADGRKARIQLDCTNLTVLITNYLTT

SEQ ID NO: 8891 - protein, 47 aa, Neisseria gonorrhoeae
NRLITTTLLYFNFHFNLTVISQMTNDMTRIQNFYIMRQLNITGRYDT

SEQ ID NO: 8892 - protein, 55 aa, Neisseria gonorrhoeae
FLQHKLNLATTMEFKHNTFNIQQNVNNIFLNTTNSRIFVQYTGNSYFSRSKTIHG

SEQ ID NO: 8893 - protein, 7 aa, Neisseria gonorrhoeae
DTAQSIT

SEQ ID NO: 8894 - protein, 38 aa, Neisseria gonorrhoeae
GMTETTFKWLHRYFCTSCRKSIYINLTRFQKFGCAILH

SEQ ID NO: 8895 - protein, 75 aa, Neisseria gonorrhoeae
DNITSFHLERRNIDNLSIYNYSLMRNKLSCFSSGRTETHTINDIIQTRFQQLQQQLASRTFTAISFCEITTELTF

SEQ ID NO: 8896 - protein, 18 aa, Neisseria gonorrhoeae
YAINTADFLFFTQLQTIV

SEQ ID NO: 8897 - protein, 48 aa, Neisseria gonorrhoeae
QTRFFCTMLTGSGINFTFRIQRAARTLQKQIRTFATCQLTFRANITCH

SEQ ID NO: 8898 - protein, 75 aa, Neisseria gonorrhoeae
IFNAILLGNFTSCFCCNLCCKWCTFTRTFKTSAARGSPRQRIALTVSDCNDGIVERCMNVHNTLTHGFTYFFTYT

SEQ ID NO: 8899 - protein, 7 aa, Neisseria gonorrhoeae
SCVCFSH

SEQ ID NO: 8900 - protein, 41 aa, Neisseria gonorrhoeae
AATMTEATIAAHVHQSFDTHSYFTTQITFYFILGNLITQSI

SEQ ID NO: 8901 - protein, 52 aa, Neisseria gonorrhoeae
LSLVQIFCFSIRRNICSLTNQFSTSSTNTVNSLKTNYDVCVIRDIYPCNTSH

SEQ ID NO: 8902 - protein, 44 aa, Neisseria gonorrhoeae
IIRCQLYCDLISRRNTNVMHPHLPRNMTQYNMVILKFYFKCCVR

SEQ ID NO: 8903 - protein, 16 aa, Neisseria gonorrhoeae
SFKNFTLHLDSIFFRH

SEQ ID NO: 8904 - protein, 22 aa, Neisseria gonorrhoeae
LIILLSKPIRIYLCTKIHRYNN

SEQ ID NO: 8905 - protein, 13 aa, Neisseria gonorrhoeae
NQQRRATQIKRYI

SEQ ID NO: 8906 - protein, 4 aa, Neisseria gonorrhoeae
ELWN

SEQ ID NO: 8907 - protein, 14 aa, Neisseria gonorrhoeae
TNSCNIKSSKQCQT

SEQ ID NO: 8908 - protein, 4 aa, Neisseria gonorrhoeae
YNFF

SEQ ID NO: 8909 - protein, 19 aa, Neisseria gonorrhoeae
IPRGLLTRSNPRNKSTTLF

SEQ ID NO: 8910 - protein, 25 aa, Neisseria gonorrhoeae
ILCHFFRTKNQSRIKITKENNCRCK

SEQ ID NO: 8911 - protein, 9 aa, Neisseria gonorrhoeae
SHIQQLTVL

SEQ ID NO: 8912 - protein, 18 aa, Neisseria gonorrhoeae
QSSYFVQNTICISRTKPT

SEQ ID NO: 8913 - protein, 5 aa, Neisseria gonorrhoeae
KSRWK

SEQ ID NO: 8914 - protein, 53 aa, Neisseria gonorrhoeae
NNTGSKNWGNNTSHIQLERHMRTLTTRPTIKLAFCIMNRNLPLCTFKVYNQIN

SEQ ID NO: 8915 - protein, 30 aa, Neisseria gonorrhoeae
GTKYNKQRRKHAHRTLVRQCNQLCNTRRNT

SEQ ID NO: 8916 - protein, 7 aa, Neisseria gonorrhoeae
SNTCRND

SEQ ID NO: 8917 - protein, 35 aa, Neisseria gonorrhoeae
RNTVPDTPFSNLLPKPHKKHGSRYQRNYRGNMKLK

SEQ ID NO: 8918 - protein, 15 aa, Neisseria gonorrhoeae
TCYNNSLLKYERCNT

SEQ ID NO: 8919 - protein, 5 aa, Neisseria gonorrhoeae
TLKNC

SEQ ID NO: 8920 - protein, 21 aa, Neisseria gonorrhoeae
QNSTIPSIFRNYLSTSLPFFF

SEQ ID NO: 8921 - protein, 13 aa, Neisseria gonorrhoeae
WQNFRSELYNNRS

SEQ ID NO: 8922 - protein, 14 aa, Neisseria gonorrhoeae
NIWHNSYCKYTKAL

SEQ ID NO: 8923 - protein, 19 aa, Neisseria gonorrhoeae
RPTGKHIQYSQDAVSSAFV

SEQ ID NO: 8924 - protein, 22 aa, Neisseria gonorrhoeae
SNSINPRYGYMGTNSKNNQCSK

SEQ ID NO: 8925 - protein, 12 aa, Neisseria gonorrhoeae
KQKTFLKISKLG

SEQ ID NO: 8926 - protein, 6 aa, Neisseria gonorrhoeae
RLLISH

SEQ ID NO: 8927 - protein, 8 aa, Neisseria gonorrhoeae
NINLINSN

SEQ ID NO: 8928 - protein, 4 aa, Neisseria gonorrhoeae
FQFT

SEQ ID NO: 8929 - protein, 6 aa, Neisseria gonorrhoeae
TKLCIS

SEQ ID NO: 8930 - protein, 68 aa, Neisseria gonorrhoeae
RFKTSFREASLQGHLTTLETHLMKPTRPALLTFMTTTTRFAKTTTNTASNTTTSMRSTNSRLNCIQKH

SEQ ID NO: 8931 - protein, 11 aa, Neisseria gonorrhoeae
NLYRMLATTQT

SEQ ID NO: 8932 - protein, 28 aa, Neisseria gonorrhoeae
TACTCTMRFNCTNQAFNQCNPNLFLFSH

SEQ ID NO: 8933 - protein, 64 aa, Neisseria gonorrhoeae
CCTYDIIWVSRSVHFGGNIMNAHSIKNQTHRSTGFYATTLFSRLHKYFSSTMSTNNLMMDRTIF

SEQ ID NO: 8934 - protein, 22 aa, Neisseria gonorrhoeae
WYLNHRASCLIHRLLDCNRHFF

SEQ ID NO: 8935 - protein, 16 aa, Neisseria gonorrhoeae
LTFTHTNTTISITNNS

SEQ ID NO: 8936 - protein, 37 aa, Neisseria gonorrhoeae
RRESHNATTFNYFGYTVNCDHLFNQTVTAFFNFMFCH

SEQ ID NO: 8937 - protein, 68 aa, Neisseria gonorrhoeae
TIKSNLFYTCCFSLLSNTFTNYCSCFNIASRFQTTAHLSFQCRGLSQYFITFSTNYLSINMIIASEHT

SEQ ID NO: 8938 - protein, 25 aa, Neisseria gonorrhoeae
SYHFQVRNTSTGFACTTESGCMFIH

SEQ ID NO: 8939 - protein, 45 aa, Neisseria gonorrhoeae
NNLCLARSLNGDTFRHFIYDRMRKTQRQIQDFTLCLSTITHAHQL

SEQ ID NO: 8940 - protein, 6 aa, Neisseria gonorrhoeae
FLLKTF

SEQ ID NO: 8941 - protein, 8 aa, Neisseria gonorrhoeae
NTFNHIAD

SEQ ID NO: 8942 - protein, 68 aa, Neisseria gonorrhoeae
CASSTRHCICLFTAIIRNKSQFAIIKFNGYIRMQRKRQFTVLTLNNQCLCSKFYFYTSGNRHWVFCDT

SEQ ID NO: 8943 - protein, 62 aa, Neisseria gonorrhoeae
QLTTNTLRTCFTISHYTFRSTNDSNTQAIHNTWNLTRRFINTQTGARYTLDLFNYRTTCIVF

SEQ ID NO: 8944 - protein, 10 aa, Neisseria gonorrhoeae
LNFQYRLYVR

SEQ ID NO: 8945 - protein, 19 aa, Neisseria gonorrhoeae
NCEVLNISFFFQYLCNSTL

SEQ ID NO: 8946 - protein, 29 aa, Neisseria gonorrhoeae
RRHCNCCFISTLRIADTSQHIGNRIMHTH

SEQ ID NO: 8947 - protein, 47 aa, Neisseria gonorrhoeae
SFRFLIGFCCSSNSNIQTTQSINFIVFNFRENNLLTNTHIVIATTIK

SEQ ID NO: 8948 - protein, 12 aa, Neisseria gonorrhoeae
FTAHTTEVTYAR

SEQ ID NO: 8949 - protein, 50 aa, Neisseria gonorrhoeae
CNSNQTIQEFKHLITTQCYFATNRIVITDFKTCDRFTGNSNNRSLTGNSL

SEQ ID NO: 8950 - protein, 32 aa, Neisseria gonorrhoeae
IGNSMFHNFFVSNSLTHTHIQGDFFNTRDFHY

SEQ ID NO: 8951 - protein, 23 aa, Neisseria gonorrhoeae
FVTKLFNQFRNNCLFIKLSQPSH

SEQ ID NO: 8952 - protein, 99 aa, Neisseria gonorrhoeae
FEETNAFNFAFIFNQLNTNTVRFISFRIQDCDIRNIQRHFFSNNTALNATHWIRFLMAFYNINALNNNFTTQHSNYLTLLTFILTSNYYNPIAFNDFIH

SEQ ID NO: 8953 - protein, 39 aa, Neisseria gonorrhoeae
NDFHKSLSTQFTGYRTKDTSTQRFKFIIQQHGGIVIEFN

SEQ ID NO: 8954 - protein, 67 aa, Neisseria gonorrhoeae
RTIRTTHTLSSTNNYRIIYIAFFDTATRNRIFNCHFNNIANRSVATLRSAQYLDTHYATRTRVISHI

SEQ ID NO: 8955 - protein, 7 aa, Neisseria gonorrhoeae
DGLHLNH

SEQ ID NO: 8956 - protein, 27 aa, Neisseria gonorrhoeae
QWTGFRYNNHITNSILIIFIMGMDFSR

SEQ ID NO: 8957 - protein, 41 aa, Neisseria gonorrhoeae
SNNLTIQRMFYFTLNQYCYGFIHFVAYYFALQSTNIFSFAH

SEQ ID NO: 8958 - protein, 19 aa, Neisseria gonorrhoeae
NGFNTSNIATYTFQFTWFA

SEQ ID NO: 8959 - protein, 8 aa, Neisseria gonorrhoeae
LTGSVLHT

SEQ ID NO: 8960 - protein, 27 aa, Neisseria gonorrhoeae
AKLSFQQVQQICIQLLNGFVFQFICFH

SEQ ID NO: 8961 - protein, 23 aa, Neisseria gonorrhoeae
SMQWHATFTIPFATGNIRTIQTA

SEQ ID NO: 8962 - protein, 133 aa, Neisseria gonorrhoeae
SHNLNAFSTRTHCILHCSFHSTTELNAFFQLLGDTVSNNLSIQLRTANLFNIYMNRYTHQDLQVTFQNFDILTFFTDNHTRTSGVNGNACRFCRAFNNYSTNRSIGQFLTQIIANIDILLQNSRKVGTFSKPF

SEQ ID NO: 8963 - protein, 19 aa, Neisseria gonorrhoeae
SPVFSYRQAKACRVNLLSH

SEQ ID NO: 8964 - protein, 52 aa, Neisseria gonorrhoeae
LQYFFDQLGTFFRAESQNIQSLGNVFTTNQISYQTSLLSRDTGIFMLCIYSH

SEQ ID NO: 8965 - protein, 66 aa, Neisseria gonorrhoeae
FMTNHIVADKHRHMGATVVHGNGQTDKIRQNGRTTRPGFNRAFVVACANSIYFFQQMQVYIWAFFQ

SEQ ID NO: 8966 - protein, 34 aa, Neisseria gonorrhoeae
LCNRIFSDDYFFITQQAVRINLLSFQNQYVWQVA

SEQ ID NO: 8967 - protein, 106 aa, Neisseria gonorrhoeae
SQVNILVEPFGYKQHLLQSQIFYLFGKNFGFGSFGSQRLNHKQTLVTRQLGQDSRHTGTVHFTVYFLSEVFVGFVRERATAFTPQRRRSHTGTGAAGTFLTPWFFG

SEQ ID NO: 8968 - protein, 45 aa, Neisseria gonorrhoeae
VFYFGTGFLSTVTRAGVCQVGIYQLVNQRFIVFAGEQSIRNRQAA

SEQ ID NO: 8969 - protein, 12 aa, Neisseria gonorrhoeae
NLSFSVNYFQFH

SEQ ID NO: 8970 - protein, 21 aa, Neisseria gonorrhoeae
SHDYFPFKVKGQAAIGLSFRQ

SEQ ID NO: 8971 - protein, 4 aa, Neisseria gonorrhoeae
NIVD

SEQ ID NO: 8972 - protein, 12 aa, Neisseria gonorrhoeae
IRTKRRSRRQYK

SEQ ID NO: 8973 - protein, 6 aa, Neisseria gonorrhoeae
YGKARQ

SEQ ID NO: 8974 - protein, 45 aa, Neisseria gonorrhoeae
NQMDASAQTKPDSTFFRGASLRKVMDKKYPVLFTKKCRLKILEAQ

SEQ ID NO: 8975 - protein, 17 aa, Neisseria gonorrhoeae
ICLPPHIFRRHNIKNPQ

SEQ ID NO: 8976 - protein, 35 aa, Neisseria gonorrhoeae
NSSQSSSQGGFTMVNVTDGANVYVRFATFEFFLSH

SEQ ID NO: 8977 - protein, 338 aa, Neisseria gonorrhoeae
VNADKGQLTDVFVVQHFECQCREFLFIAGLTAVGFFSVRINTLNRRNIGRSWQQFYNCVQHTLNTFVFKCRTAQHRLNFACQSTLTQRAYDFFFGQIFTAQVFVHQFFAGFGCGFNHILTPFFGSFDQFGRNIAIGKGCTFIGFIPDDRFHFQQIDNTGKTVFRAYRNDDRYGVCAQTGFHLLDNAEEVGTLAVHFIDKRQARNLVFVGLPPYGFRLRLNTAHRTVNHYRAVQYTHRTLYLYGKVNVPRGVDDVEAVLGELFRHTGPVGSNGSGGNGNTALLLLFHVVGSSRTVMHFAQLVGQTGIEQNTFCRRGFTRIDMGGNTDVAVQADRGLTSH

SEQ ID NO: 8978 - protein, 93 aa, Neisseria gonorrhoeae
RTNFNRNLVVCTTYTAAFHFHDRFGVCNGFVKYFDCCFAGFFLNLFQRTVNDTLGNGFFTVNHQYVHEFGQLDATEFRIWQYVALGDFSTSWH

SEQ ID NO: 8979 - protein, 64 aa, Neisseria gonorrhoeae
NDFKTVGQADFTYFTQCRVRFSRGSRVYTGAHAAFLRAGFQCGHFVYVHGLLTAFAYQLVDSWH

SEQ ID NO: 8980 - protein, 27 aa, Neisseria gonorrhoeae
IFTDIPHNQSDGWRKYCQYVFSILTNH

SEQ ID NO: 8981 - protein, 4 aa, Neisseria gonorrhoeae
SRAH

SEQ ID NO: 8982 - protein, 22 aa, Neisseria gonorrhoeae
CCRGFKYPFRVTRTQLQSKTAV

SEQ ID NO: 8983 - protein, 12 aa, Neisseria gonorrhoeae
YFHRTQTYTITP

SEQ ID NO: 8984 - protein, 96 aa, Neisseria gonorrhoeae
SLLFLHSIIKHTANTPVQLPSRHSVIAERTAHRNRFTVVTFCQIFVMVLFAAILERLGAAPFFIQTAAVIQHNTRICRITVIAQPVLFDKGPESPL

SEQ ID NO: 8985 - protein, 32 aa, Neisseria gonorrhoeae
TAIPITVAYFGMKRLFAKIPGIPIMHTGTADA

SEQ ID NO: 8986 - protein, 43 aa, Neisseria gonorrhoeae
AGKVIACHVKHPINAQFVPYPVGAFGQAVFRFYPFPAVDDDVP

SEQ ID NO: 8987 - protein, 82 aa, Neisseria gonorrhoeae
KGRIVYIICLFIVHIERRMPRLHRFRLTDIFPCKLPHIGRQHLLGPVQLNQCLTILFVFKQHHAQIKTGINKIGSFRQQLTV

SEQ ID NO: 8988 - protein, 6 aa, Neisseria gonorrhoeae
IGRLEH

SEQ ID NO: 8989 - protein, 18 aa, Neisseria gonorrhoeae
VSHKKDIFRFHQFHNKFK

SEQ ID NO: 8990 - protein, 6 aa, Neisseria gonorrhoeae
NAQQRH

SEQ ID NO: 8991 - protein, 34 aa, Neisseria gonorrhoeae
HSHPFVHAEIRNPVFQPQAGAGLSIRDSLNSSFF

SEQ ID NO: 8992 - protein, 11 aa, Neisseria gonorrhoeae
FDLAILFHSFN

SEQ ID NO: 8993 - protein, 20 aa, Neisseria gonorrhoeae
ARAFSTIKINCVSKYAIMVI

SEQ ID NO: 8994 - protein, 4 aa, Neisseria gonorrhoeae
RFFG

SEQ ID NO: 8995 - protein, 18 aa, Neisseria gonorrhoeae
NPITAKCPTFILKAPSLG

SEQ ID NO: 8996 - protein, 54 aa, Neisseria gonorrhoeae
FVFICCHASNVAQIQVKRNLFRILSIPFYRITVFSTVAKIASNHRIRLLINPSF

SEQ ID NO: 8997 - protein, 24 aa, Neisseria gonorrhoeae
RIILFFIRTVKLNLLLTQTFGENI

SEQ ID NO: 8998 - protein, 30 aa, Neisseria gonorrhoeae
FPPLTTFVFFTINIYIHLLKLFLTKRLFAV

SEQ ID NO: 8999 - protein, 27 aa, Neisseria gonorrhoeae
HCLDRFTLTELTCILFSHSCIFITFNL

SEQ ID NO: 9000 - protein, 11 aa, Neisseria gonorrhoeae
YFGLQFFWYIF

SEQ ID NO: 9001 - protein, 31 aa, Neisseria gonorrhoeae
FLQIFNNFFIFRINICIVFQLFRNAWLNRHR

SEQ ID NO: 9002 - protein, 9 aa, Neisseria gonorrhoeae
IGTATRARC

SEQ ID NO: 9003 - protein, 14 aa, Neisseria gonorrhoeae
PHRSNNSNNKFIHC

SEQ ID NO: 9004 - protein, 5 aa, Neisseria gonorrhoeae
LRYFH

SEQ ID NO: 9005 - protein, 34 aa, Neisseria gonorrhoeae
RIDNVRRGNTTQNTIAQCFNHITALYHCLHDKAV

SEQ ID NO: 9006 - protein, 55 aa, Neisseria gonorrhoeae
STAIVFNNDQVLSYIHQTTGQVTGVRGFQRGIRQTLTRTVGRNKVLQYGQTFAEV

SEQ ID NO: 9007 - protein, 42 aa, Neisseria gonorrhoeae
GNRRFNNRSVRFRHQTAHTGQLFNLSRRTTGTGVRHHINGVE

SEQ ID NO: 9008 - protein, 230 aa, Neisseria gonorrhoeae
LLIDFVAVTVDNFLFGQVVHHRFSNLIAGTTPNIDHFVVAFAVGNQTLTVLVFDFFNFGIGFSQQGRFFFWNFHIVNGNGNTAFCRKSETGVHQVVGEDNRIAQAAQAERCVNQLGNFFFLQRFVDIFKRQAFRQDFAQQCTADGCFVTVNDRLKLTCFVFHPFAQTYGDFCTQLDLFGMVCTMHFFHIGKQAALAFGIDTVAGHVVQTQYDVLGRYDNRFAVGRRQYVV

SEQ ID NO: 9009 - protein, 454 aa, Neisseria gonorrhoeae
SQHQRACFHLRFQAQWNVYCHLVTVKVGIKCGTHQWVQLNRFTFDQNRLERLNTQTVQGRRTVQHNRMFADDFFQDIPYFRYFLFYQFFRSFNGRRQTLFFQFVENKWFEQFQRHFFRQTALVQTQVWAYGNHGTAGVVHTFAQQVLTEAAAFTFNHICQRFQRTFVGSGHGFTATAVIQQRINRFLQHTFFVADDDVRRMQFQQAFQTVVAVDDAAVQIVQIGSGKTAAVQRNQRTQIRRQYRQHIHNHPLQLHTGTMEGFQYFQAFSDFFDFGVRTGRFKLLAQDFDFACYIQGSQQFADTFRTHFGIEVVAVFVQFVVVIVFSQQLTTLQRSHAGIGHHECFKVQYAFDITQRHVQYHTQAGRQGFQEPNMGNGCSQFDMAHAFAAHFGQGNFYATFFTGYAFKFQSFVFSAQAFVVFDRAKDFGAEQAVALGFERTVVDGFRFFNFAIRP

SEQ ID NO: 9010 - protein, 27 aa, Neisseria gonorrhoeae
ADGFGRGNTDFDGIKLFFHTCGLQRIK

SEQ ID NO: 9011 - protein, 5 aa, Neisseria gonorrhoeae
VQQIH

SEQ ID NO: 9012 - protein, 114 aa, Neisseria gonorrhoeae
ANLFDQYVEGLGHTGIDFVFAFDDVFVHFGTAVHVVRLHSQHLLQRVCRAVCFQCPNLHLTETLAAKLSFTAQRLLSNQTVRAGRTRVHFFVNQVVQFQIVHHTDCNLAVKCFA

SEQ ID NO: 9013 - protein, 322 aa, Neisseria gonorrhoeae
TAVIQRDLSFTVVEAQFLNLRIFAWVSQVQHFADFRLFRTVEYRRGERCTFTQIGSQFDDFFISQAVQIFFLTAAVVEFVQELAQLAGFASLFQHTVDALADTFCRPTQVNFQNLTDVHTGRYAQRVQYDVHRTAVRHVRHVFHRQNARYHTFITVAARHFVTGLQTAFDGDKDFHHFLYAGLQLVALGQFFLLDLIQLIRFFAFLLQAQFNQFQLLGQIFIGQTDIEPIVPARQTRQIFGRDFAAFGQLHRAAVGFLTDNHTLDTVECVVVENTQLVVQIQTVAFQLGIDNGLGAFVALDAFAGKDLNVDNRTAHTGRHTQ

SEQ ID NO: 9014 - protein, 291 aa, Neisseria gonorrhoeae
SIFYVRRFFAEDGAQQFFFRRQLGFAFRRYLAYQHIAGFYFRTDVNDTGFVQTVLHTLGQVRNIAGNVFRTQLGIAGNDIQFLNVNRSIAVVRSHFFGNQNRVFVVVTVPRHEGDGHILTQSQFAQIGGRAVGHQIAALQNIACFDSRTLVDVGRLIGTGEFNQIVNIDTHFTGSRFVVMDTDHNAVGIDILDHAASAGNDCSSRVNGNGTLDTGTDHRFFRTQTRHCLTLHVGTHQCAVRVIVFQERNQGCRNGYHLTGCHVHILDAVGRCHNGFAFFTTGNQIANQIAV

SEQ ID NO: 9015 - protein, 50 aa, Neisseria gonorrhoeae
IQIGIRLCNHIAAFFDGRQVINFLGYFAVNNAAVRRFQETVIIGARVNRQ

SEQ ID NO: 9016 - protein, 89 aa, Neisseria gonorrhoeae
VDQTDVRTFRRFNRTYTSIVGRMHVPHFEAGTFAGQTARTQCRYTAFMGYFRQGIGLIHKLTQLAGAEEFFDGGRNGFRINQVVRHQVF

SEQ ID NO: 9017 - protein, 272 aa, Neisseria gonorrhoeae
FRLIQTFFYGTFHTSQTAAELVFSQLAYRPYSTVAQVIDIVHFAMAVTQLDQSRNRGDNIFDAQDITAFVGSTGKRLVQQAAVPRVLLGFGQFLFVCARIKFHTAYAGQIVAVFTEEQAVKQLLDRLFGGRFARTHHTVNRNTRRLPAGSLIRAQGIGNISTLIQLIDVKGRNFFYAVNIKFGQQLFCNFIIGRSQYLAGFRINQIGSQCFAQQAFLFYIQTGQACIGNITDIFRSNALTFGNQYIAFFIQDIDLGSFAFQTACDQIGLNTV

SEQ ID NO: 9018 - protein, 51 aa, Neisseria gonorrhoeae
RQIKRFFVVENIQDLLIVVAQSLQQNRYRHFTAAVDTEIQQIFRIKFKIQP

SEQ ID NO: 9019 - protein, 10 aa, Neisseria gonorrhoeae
TTVGNDAGGE

SEQ ID NO: 9020 - protein, 147 aa, Neisseria gonorrhoeae
QFAGRVCLTFVMLEEHTGRTVQLGNNHTLCAVNHKRTARGHQRNFAHIHFVFTNFFYRRFRRFLIQNHQTDTRAQRGSISDSAQLTFRDIEQRLAQRVIYKLQTSITVVAHNRENRIKCRLQTVIGTFVKSIFQLQKFRIRINLGCQ

SEQ ID NO: 9021 - protein, 28 aa, Neisseria gonorrhoeae
KRNFQNIFPLCKTLTDTFFLGKRIVHTH

SEQ ID NO: 9022 - protein, 11 aa, Neisseria gonorrhoeae
FDKNYANKCKQ

SEQ ID NO: 9023 - protein, 67 aa, Neisseria gonorrhoeae
STLHCATSQSIFQNAQINAFFTCIRTKLSHTGNTDTAIFSDYEGLSISNCRANFLDRHFLGFNIETQ

SEQ ID NO: 9024 - protein, 6 aa, Neisseria gonorrhoeae
CINANT

SEQ ID NO: 9025 - protein, 40 aa, Neisseria gonorrhoeae
THSAGYSNFFQVLTFSSSRFGFNDSVQQRIKVLFQISFSE

SEQ ID NO: 9026 - protein, 116 aa, Neisseria gonorrhoeae
STTNRCMNNTCLVGTVLHLTCFCIFYRFGNIRGNRTYFRVWHQTTRTQDGTQLTNDTHCIRRSNNNIKVQIACFDFSSQIFETDDIRTSLFSSFCIYTLSKYSHTGCLTSTFRQND

SEQ ID NO: 9027 - protein, 61 aa, Neisseria gonorrhoeae
TTDNLVRFTRINAQVERYVNRFVKFSGSSFFNQGNCFVDCVQFVSFNRRAKNFQAFRYFSH

SEQ ID NO: 9028 - protein, 68 aa, Neisseria gonorrhoeae
ASRTCYSTNSRIQVSSSQIRLFSFSNFFQLGTGQFTYLVCQRIRTTFLQTGGFFQQNRSRRSFHHKCE

SEQ ID NO: 9029 - protein, 65 aa, Neisseria gonorrhoeae
FICKCSNHNRNWQTRFHTLGCSIKCFTEFHDIQTTLTQSRTNWGGWIGFACRNLQFNIADNFLCH

SEQ ID NO: 9030 - protein, 45 aa, Neisseria gonorrhoeae
LIPFIIDLLNHPVKIRKRSFIYTNLLTDLKFNFWFRLLYAGLNLL

SEQ ID NO: 9031 - protein, 41 aa, Neisseria gonorrhoeae
NNFSLSLTNRRGSISPPSNKTRNTGSAFYKMPRVICHFHLN

SEQ ID NO: 9032 - protein, 5 aa, Neisseria gonorrhoeae
HITRI

SEQ ID NO: 9033 - protein, 59 aa, Neisseria gonorrhoeae
LSFTNSLTTIADINNFLYRHQNLSEIISHLLTGNSLFQYSLDILLKPRIRLYNIPFFRH

SEQ ID NO: 9034 - protein, 44 aa, Neisseria gonorrhoeae
PRNCCICRIDKYRKHSNKHYNKYSHSDGIFTLRPNHLFEFGPRI

SEQ ID NO: 9035 - protein, 36 aa, Neisseria gonorrhoeae
EICKKTLLTGIRCRFFILNNQLIHFNILFFRRMFCH

SEQ ID NO: 9036 - protein, 35 aa, Neisseria gonorrhoeae
FKRFARFRIECGSVFGRHTEYAIADNFTKYTAPFH

SEQ ID NO: 9037 - protein, 35 aa, Neisseria gonorrhoeae
NSSQSGSQGGFTMVNVTDGANVYVRFATFEFFLSH

SEQ ID NO: 9038 - protein, 63 aa, Neisseria gonorrhoeae
FKCTLPRLPLPISRQPIRFVRLPACLDINICAVIQACAQYIEKTFPTLPRKRRIKEDDIEFLF

SEQ ID NO: 9039 - protein, 117 aa, Neisseria gonorrhoeae
VCQIGNAVRTDGLHLPQTQFAAVFLKGLHRLTVVVCNHDPFCITRCRLHAECAAASEEIQNRFSRQILSQPVKQLFTHAVGGWAQSVGGCKTQFPAPALPADNAYPVAVFGMFACRH

SEQ ID NO: 9040 - protein, 52 aa, Neisseria gonorrhoeae
QIQLYRCILSGIDCKFPAVGIHIVNLQHHPSATRFERIPTNPDSRLRGNGGF

SEQ ID NO: 9041 - protein, 29 aa, Neisseria gonorrhoeae
GYGVSAMAVRVFPRTCPAPVNGERVKNAV

SEQ ID NO: 9042 - protein, 5 aa, Neisseria gonorrhoeae
RFRRH

SEQ ID NO: 9043 - protein, 57 aa, Neisseria gonorrhoeae
GFVGFEAGVFQASPIVVAVAGVQGQAGRDVYAHARHRAEAQAAAAAVFVIGRFGGHF

SEQ ID NO: 9044 - protein, 22 aa, Neisseria gonorrhoeae
WNRSFRTTVAWVSGNSRGFFFH

SEQ ID NO: 9045 - protein, 29 aa, Neisseria gonorrhoeae
MNLMSDVSVGDAHADIGFEFIVGSEIVNG

SEQ ID NO: 9046 - protein, 162 aa, Neisseria gonorrhoeae
QAERRNGVECAVFLMFRLLGFYVKMLAVRSAIIVSSQLFYVHGIFIVVPFPVTGIIRGDAPAAEIVAEGKPGVDGAGADVFEIIAYRAYFFALVCTGCIGIIAGDVLVGVSQIRLHIRAAPMVFTRRPRCGREEKRREEKRREEKRREEKRREVFCRPYAYQ

SEQ ID NO: 9047 - protein, 6 aa, Neisseria gonorrhoeae
NPGQPG

SEQ ID NO: 9048 - protein, 7 aa, Neisseria gonorrhoeae
ILLYQLF

SEQ ID NO: 9049 - protein, 34 aa, Neisseria gonorrhoeae
NGNSNFYPTVVKTPSALLQIQPEMLFGNAVKLAQ

SEQ ID NO: 9050 - protein, 74 aa, Neisseria gonorrhoeae
TMLPGFTRPRIIGNKIAVRVSDSNRTNLAVALQKPEYGGFAGGTAAASAFTEITFTRPCFAVIHFQMRTVLTDK

SEQ ID NO: 9051 - protein, 7 aa, Neisseria gonorrhoeae
TICRMPP

SEQ ID NO: 9052 - protein, 23 aa, Neisseria gonorrhoeae
FRRFRPNACKGSFPDDVPNTISP

SEQ ID NO: 9053 - protein, 13 aa, Neisseria gonorrhoeae
KITGCRVLINCCQ

SEQ ID NO: 9054 - protein, 296 aa, Neisseria gonorrhoeae
RFVSQIHAVGTHIGNQTDGTLPYVYTFVKLLGGTHGAVGGEAQFTHGILLHGGCGKRRGGVAAALFLFDGGNDGLFAFEFFQHIGLSGFVRQVELFEFRAVVLGEFGGELAAAFMAVEMHRPIFLRFKRADFVFALANQPQGGTLHTARAQTASDFFPQQRREVETDQIVQSAAGLLRIDQIHFDFARMGDGIEHGVFGNLVEHDALRLDVFQTAFGFEDFQKMPRNRFAFPVRVGCEVDVFGFFGSGNNRIDMFAVAADELVFHRKAVVGIDRAAFGDEVADVSVGREDFKIAAQ

SEQ ID NO: 9055 - protein, 19 aa, Neisseria gonorrhoeae
KRAHQLVADQYGQLALVCP

SEQ ID NO: 9056 - protein, 124 aa, Neisseria gonorrhoeae
KQQGQHFGGIYGNFVAGDVHERVDDDFPLFAADGFFFNQILHQPHHFLRQVVGFFFAVHAQCAAAGGFGGKFGAVEQYFHHHQGVADFHRIETRFFKQHTQVFGRRAGIEILEMFDEVGDDFGH

SEQ ID NO: 9057 - protein, 7 aa, Neisseria gonorrhoeae
RSTRILQ

SEQ ID NO: 9058 - protein, 297 aa, Neisseria gonorrhoeae
PRAFVQDVVQTFRQFRSVFNQFVAAFAVGVVYRTGYRHHFAPHFCRQAGGNQRTGFQGGLDHQRNLRQRGNQAVAARKVAGIRPRADGELADNQPFFGDFIGKVFVGRRINAVYARPPHGDGAAFCLQCALMGGGVDARSHTRHGRNAFPTQRPAEIFGNPHRLRRGMAAADDGGGRLVQQPHVAAQKQNRRRGQPLRQHFGEIFILKQHQAASVPHFPFQRRFCRLPRQSAFFRIAPSLKRVLMPHRRGNLFRRCGQGILRAAETAHQQQETFRADIGRKRQLQPRETFVLCHKIH

SEQ ID NO: 9059 - protein, 117 aa, Neisseria gonorrhoeae
FAQRQVKVEPARHMPRSVGRHAAPQCRRSRADTDFLPVRLQQQRCHDVLQLLEIPRPVVTGQYGKRIVTECGRRDFLAFRHIAGNPLYQEGNVFMLHTQGRNTDDRFRKKPGQFFFT

SEQ ID NO: 9060 - protein, 240 aa, Neisseria gonorrhoeae
TCRVAARSNHPDTAAFCLADDKGNAGLDIAAVLGDVADIQNAALRLLQQFHRHIDQIFDPCRTDPRRTVFMEIARHGFKRRTRLARQKYRGRALCRRFDFAVHLLNRGTVAQFVEHRSRFDLRRTVFQRVFDRRQQLLQGNRFFQKIDRADFGRFYGGIDAGMPAHHHHRHIELPVFRPLLQKGDTVAIGHPNIQQHHCRARLMAQLARLFGIFRQRDRIAFVLQDFRQQVADADFVVYN

SEQ ID NO: 9061 - protein, 6 aa, Neisseria gonorrhoeae
NIAATH

SEQ ID NO: 9062 - protein, 25 aa, Neisseria gonorrhoeae
GVQILIFQFERRGARVIAECLDHFF

SEQ ID NO: 9063 - protein, 533 aa, Neisseria gonorrhoeae
RRHLFDDGVGRTRQDLRVLIVQLPAQFPRQPFGGKLDGRERIADFVCQPLRHFTPRGFFLRAYQHGDVVNHHHHAVAVVFGQYRRLAQQDFGIVRRGIFHLDRFVRTCRRTDGGKHFGKQGLLRRNAVPTVPAAAPQGGERHPQNLFRRLVEGFQTAFFVKHHHTGSQPIQHALEVVTGGFLAPAVAFVCFFGDGKLLGHMVEQLGQTSELVVAQYGARLAEITLRHRLCALGKRQNGFDETAGKIQCHYQRKKNRQQRGNQQGYQKKGLQTFFAVTQFGIFRPRLFNQNGILCHIFGNRLAEEQRVIAPVVRTCRQPSLRVQYAAYAFQTPNRTGLLNLFPMFFVGKRLVELVRIDAFFDFPACGIVQGKLGKTAAGVVFQHTAHIARQGGGADEVYLYGNGVADGIVCRQIQCGLAQIKAAFEGFVGVVAEPRINRAVDKLRGNAEQEQAGQYGDQREHPGKAFGNLRTEHAVAPVFQQQYDITCQNGGQHQQQHCAERDYPPEIIRQRTGAAGRRRQSVQQDDGAYGCDR

SEQ ID NO: 9064 - protein, 15 aa, Neisseria gonorrhoeae
EAAHYLFPMMFRGFQ

SEQ ID NO: 9065 - protein, 24 aa, Neisseria gonorrhoeae
RFPTRIQMPVLRSQCVDLERLGQF

SEQ ID NO: 9066 - protein, 62 aa, Neisseria gonorrhoeae
SGQRQADFRLGFPCFRTGQRAFVQDFPVGNRAGRAQCRIQSVVIGGKCADGNAVAVGQRMET

SEQ ID NO: 9067 - protein, 29 aa, Neisseria gonorrhoeae
FVVNIVVIANQLPQFKPIRSDCRGGKLPA

SEQ ID NO: 9068 - protein, 67 aa, Neisseria gonorrhoeae
GKVERYAPAQRLLELVGQLGLEAAADGKPPAVGYPRFGAGRGNALRRRVRQNGEYRQQHKPLFNAFE

SEQ ID NO: 9069 - protein, 6 aa, Neisseria gonorrhoeae
ARNKSH

SEQ ID NO: 9070 - protein, 402 aa, Neisseria gonorrhoeae
KHPRFDRFGIGMAVEEFLQLPVVFFDEHGTGGKQHSAALFQRLPKCVQQGFLLAGGFERVGRSAQPFHVGIAPRHAGSGARHVGKDCVERLSIIPRRQIPRIGTRRRCRLKAQTGDIVLHTLQTACIDVQGGNAAVRQFQNMPRLAARRGARVQNPFAVFRVKEIRRLLRAEVLYRHQSFGKTGQTVYRHGFFQRNRIFVQRLSRDTFRHQFFQIAFGIAVPAVDAQRHRRMGLQRGGDVVPVFRIMVFQVSHPPQRQVVFRHIVFFAGSRQFFTFAQKAAQNRVGKRTVLPAPDFGYAFNSFVDHGVGRVARVMQLVQRRQKQAFELRIVDGLFQHLREHMFQTAQITLAAVGDILQRAVFLRRQLRMRRADVRQHVLKVAPFGNRRNAVGGKFLGKCHTH

SEQ ID NO: 9071 - protein, 189 aa, Neisseria gonorrhoeae
FLGVSYAFFGLFDRVQTAFALKLLQIGNNRRRTDFHQRVVDFVGGIGRLDGVAVFADHIAGVQTDVHLHNAHAGFGIAGLNRALNRRRAAPTGQQRSVDIEAAVFRRIQHFLRQNQAVRGNHHYVRLDLFEHLQGFGVVAQFFGLCHAQTEFQRGLFDRRGGQLHTAPFRTVGLGQHQRDFKTGGGNGF

SEQ ID NO: 9072 - protein, 27 aa, Neisseria gonorrhoeae
GGGGKIGRAGKDDFHSVFLRVRKVVGQ

SEQ ID NO: 9073 - protein, 131 aa, Neisseria gonorrhoeae
LVLHANRQQPVRLQREFFAFFVQSLDLDAFGAGNGVVNARYGQAALFVSGFAVFFNDDGVDEHARFAAVFGQIHHDHAFVHIDLRRRQPDAARFVHRFKHIGNQLPDALVNLFDRLCHRVQTLVGILQDIQ

SEQ ID NO: 9074 - protein, 16 aa, Neisseria gonorrhoeae
SHNFLFPSADTPPVFH

SEQ ID NO: 9075 - protein, 16 aa, Neisseria gonorrhoeae
SHNFLFPSADTPPVFH

SEQ ID NO: 9076 - protein, 139 aa, Neisseria gonorrhoeae
LSAPKSNAVSERQASPKMFFIFRRQFQYPFERAPFQSRRQLENIGEHAPIGFARGDRVRPQCEHIHFCQLGGNRARVFVVGQHFRLEPDLFRHAFAVVFDQQGEHLRLVFQVLQRSVQDGVYAFVLYHFFAVELFCLSL

SEQ ID NO: 9077 - protein, 63 aa, Neisseria gonorrhoeae
THRHERPRQPHQRDGGQCGQKRRQLFSIGFLIEPDLRGQKTGKENQNIKYRCETTLDRSVHHH

SEQ ID NO: 9078 - protein, 7 aa, Neisseria gonorrhoeae
PTVQNLH

SEQ ID NO: 9079 - protein, 18 aa, Neisseria gonorrhoeae
LIRKRSFSEAKMAKFAHI

SEQ ID NO: 9080 - protein, 24 aa, Neisseria gonorrhoeae
YIIATITIRINNTVRFHLFTDNRK

SEQ ID NO: 9081 - protein, 53 aa, Neisseria gonorrhoeae
SSGLSIRYCNRINLTISLQKTEYGDFTGSTATAFAFALSAKITFICFYFAIKH

SEQ ID NO: 9082 - protein, 21 aa, Neisseria gonorrhoeae
TVDYSKLSLFLCFHVAACRRQ

SEQ ID NO: 9083 - protein, 21 aa, Neisseria gonorrhoeae
GIPKKAQMLQATPSNPTAAAQ

SEQ ID NO: 9084 - protein, 24 aa, Neisseria gonorrhoeae
NISIGNTGKAGCFAPAYRIGQNAV

SEQ ID NO: 9085 - protein, 12 aa, Neisseria gonorrhoeae
NRQQGFRRHFRQ

SEQ ID NO: 9086 - protein, 22 aa, Neisseria gonorrhoeae
VGEHLVDFVVAGDIAAEYEFGI

SEQ ID NO: 9087 - protein, 54 aa, Neisseria gonorrhoeae
FRRHFADALFQFVHNVGKRQFRALFAAGFGDAVSDGTLGNHAGNQNFFALQKTH

SEQ ID NO: 9088 - protein, 251 aa, Neisseria gonorrhoeae
YGNGIGTLDVVGMQDFGFGCAFCGLGYARIAAGGIVFQNVFGGGFGRFFFTGFAAQNPDRVFFCHRLAVYHHDALHAVRQQRGRQRLRRHTDRVVDKCRPSVFGGQEADGCRQYAVFKLDIAARLLLHDVCQRRFPIQQGAVCLGIGKRFRRHGNVQIGDTERAPAFLRFRSVFQRKRQTVGGGDNFVGIDKLPAVFARERTRFLRERFLNTAAYVLQHGGVGAFQRLGRFFPAARCKQQGKRQRNEFPIH

SEQ ID NO: 9089 - protein, 229 aa, Neisseria gonorrhoeae
RAESMRDGLHICHRRRRCAQTETAVAGSQYCGIIVAPHKDIGNKSRVQNHHCGLYCKNHGYRPRQTGQLPQFQIQQRHCQEKRKRSIAEHIDGTVEHIDLECGGKDVADNHAAKQTPHEFGQVEQVFFVETVHNLGKRQTRGKHGKRFNGRFRRNQAGAFCLLEHVVRVVVLILFCVFNRFAAHFVDQAARNRPSDQAAEHQPESNRSNTQTGCADQAVLRFKIRSPRT

SEQ ID NO: 9090 - protein, 143 aa, Neisseria gonorrhoeae
RAVSARQRHRTGNQTDERVQTQSRSQSDPDKVLHQDKSAHNRGKNHQRQTARLQTGKIRAQADGREENQHKRILQRFLKFEAHAVRLVQRKQDNRGNQPARHGFGDVKITQDFDFLNQNLADQQNQSGGNQGVITVKRPFHIV

SEQ ID NO: 9091 - protein, 27 aa, Neisseria gonorrhoeae
PPKMFFFISARRGRKREDIRGIVKACQ

SEQ ID NO: 9092 - protein, 20 aa, Neisseria gonorrhoeae
HKFSMICQVRFTFVVEQIVI

SEQ ID NO: 9093 - protein, 11 aa, Neisseria gonorrhoeae
LHITPTSPNII

SEQ ID NO: 9094 - protein, 19 aa, Neisseria gonorrhoeae
PLRFHHISFIIKRNIFQIK

SEQ ID NO: 9095 - protein, 6 aa, Neisseria gonorrhoeae
AIQGTT

SEQ ID NO: 9096 - protein, 51 aa, Neisseria gonorrhoeae
QAVIWVVCFGIIRQDERLNMTGNQYRIGKFFQHTFHITVMFFTFFLKLVFV

SEQ ID NO: 9097 - protein, 24 aa, Neisseria gonorrhoeae
IRVAFPYSNFIQITKNTLGILSKI

SEQ ID NO: 9098 - protein, 6 aa, Neisseria gonorrhoeae
VITYSF

SEQ ID NO: 9099 - protein, 12 aa, Neisseria gonorrhoeae
ITYLIVFSFNKS

SEQ ID NO: 9100 - protein, 14 aa, Neisseria gonorrhoeae
FYSLLKIIIQFCFG

SEQ ID NO: 9101 - protein, 7 aa, Neisseria gonorrhoeae
IILLKGF

SEQ ID NO: 9102 - protein, 9 aa, Neisseria gonorrhoeae
HHGGNFFFI

SEQ ID NO: 9103 - protein, 24 aa, Neisseria gonorrhoeae
LALWMLDQRFNQEIYLSNIRVFSY

SEQ ID NO: 9104 - protein, 13 aa, Neisseria gonorrhoeae
TLKARVRIYDFGK

SEQ ID NO: 9105 - protein, 14 aa, Neisseria gonorrhoeae
GLSFSVSTSLYIIS

SEQ ID NO: 9106 - protein, 4 aa, Neisseria gonorrhoeae
RCIA

SEQ ID NO: 9107 - protein, 7 aa, Neisseria gonorrhoeae
KRFYKSH

SEQ ID NO: 9108 - protein, 51 aa, Neisseria gonorrhoeae
FVAVWLVLIRINKVKTNIECSTKFLIVIICKGIGKRPIIFINLAVWLIITH

SEQ ID NO: 9109 - protein, 32 aa, Neisseria gonorrhoeae
KQNFLMALLLFFSCNLINVRRFQDLYISPIFT

SEQ ID NO: 9110 - protein, 6 aa, Neisseria gonorrhoeae
FISVWI

SEQ ID NO: 9111 - protein, 5 aa, Neisseria gonorrhoeae
SIVVA

SEQ ID NO: 9112 - protein, 15 aa, Neisseria gonorrhoeae
QPIFKWFQMIDYPFK

SEQ ID NO: 9113 - protein, 18 aa, Neisseria gonorrhoeae
FDSLLFIHEMIGKWFGYG

SEQ ID NO: 9114 - protein, 6 aa, Neisseria gonorrhoeae
CNVTVQ

SEQ ID NO: 9115 - protein, 16 aa, Neisseria gonorrhoeae
SVKAKIIVHRACVRWV

SEQ ID NO: 9116 - protein, 9 aa, Neisseria gonorrhoeae
IDGISLYIR

SEQ ID NO: 9117 - protein, 64 aa, Neisseria gonorrhoeae
IKYILIKGVMPPAIIENSLVIVIQILQKMTLKTFIVVGASTAIFSITVFFITQLFNFFPRNCES

SEQ ID NO: 9118 - protein, 11 aa, Neisseria gonorrhoeae
IGHFTYHGATH

SEQ ID NO: 9119 - protein, 46 aa, Neisseria gonorrhoeae
SKRQSTFILVIQLPYIFTVQIKLLAFIVKIEFFGITLTHKTGMRAA

SEQ ID NO: 9120 - protein, 9 aa, Neisseria gonorrhoeae
KNHCDIIVI

SEQ ID NO: 9121 - protein, 7 aa, Neisseria gonorrhoeae
CFMVVFY

SEQ ID NO: 9122 - protein, 68 aa, Neisseria gonorrhoeae
SNLVINCQNIVSNHTIAAFFGFVGKGTASTKYICNCIYIRRKLVTNPGSYFLFITDIVNFRIFLIHFH

SEQ ID NO: 9123 - protein, 9 aa, Neisseria gonorrhoeae
NTFSNSFCQ

SEQ ID NO: 9124 - protein, 26 aa, Neisseria gonorrhoeae
RRHGVTNLLLLGNFAAAKNKIIRERL

SEQ ID NO: 9125 - protein, 4 aa, Neisseria gonorrhoeae
FTNG

SEQ ID NO: 9126 - protein, 37 aa, Neisseria gonorrhoeae
SPILFIVKNFAHISCNTNGWFVAVVTDVFTDITCFRT

SEQ ID NO: 9127 - protein, 18 aa, Neisseria gonorrhoeae
WFRNIVTVTSIFNKCHFF

SEQ ID NO: 9128 - protein, 29 aa, Neisseria gonorrhoeae
HLCRMIHSFMICNVWIAFASSQFWKMSYC

SEQ ID NO: 9129 - protein, 62 aa, Neisseria gonorrhoeae
SNSLMGNLQRFGKGNFAFIPPPDKYHSATYLRNTEIGCTQYLTFHRITDILKCLNNLNTCFT

SEQ ID NO: 9130 - protein, 28 aa, Neisseria gonorrhoeae
IVCIESRYIFHNKKIWLDNFNYSDKLFK

SEQ ID NO: 9131 - protein, 30 aa, Neisseria gonorrhoeae
MVAWVICKCPSNLSCHTKTLTRWSSNNQIN

SEQ ID NO: 9132 - protein, 7 aa, Neisseria gonorrhoeae
LSVKTIG

SEQ ID NO: 9133 - protein, 4 aa, Neisseria gonorrhoeae
ILFG

SEQ ID NO: 9134 - protein, 4 aa, Neisseria gonorrhoeae
IFLQ

SEQ ID NO: 9135 - protein, 33 aa, Neisseria gonorrhoeae
LMTGEVGTVSLTIIRLHFNRKQLLESGLFKTQG

SEQ ID NO: 9136 - protein, 4 aa, Neisseria gonorrhoeae
ASCS

SEQ ID NO: 9137 - protein, 11 aa, Neisseria gonorrhoeae
EKVNIGKWCVH

SEQ ID NO: 9138 - protein, 24 aa, Neisseria gonorrhoeae
QFFSAVERAVFITVGDDVLGKGLI

SEQ ID NO: 9139 - protein, 75 aa, Neisseria gonorrhoeae
TGNPRQERGGGGVRVHADGVHAVFDHRVQRFGEPALVHVVLILPHADGFGVDFDQLGKRVLQPAGDGHCAAQGNI

SEQ ID NO: 9140 - protein, 164 aa, Neisseria gonorrhoeae
VGKLARRQFGRRINRRAGFGNDDFVQAAFGHSAHQFARDFVGFAAGGAVADGDELHTVLFNQARQRCQHIVFLMQIDNDRIQQFARVVHHGAFHAVAVAGVESQSGQPPGGRGEQQVFEIAGEHGNRVSVGSFFQTIESFEFQRQKDFRAPSQAHGVAQPFVAV

SEQ ID NO: 9141 - protein, 178 aa, Neisseria gonorrhoeae
NLEAAGDDLLVFALLRNRRVVGLVFERDVQHAFVATAQNRQRAVAGHGAHGFAAVEIIAEFFAFGFFAFNDLRVDFGFVPQLVAQRADEFRVFGKLLHQNRARAIQRGFGVGDVFVQVALRGGFHVLRLFGKQHVRQRLQTVFVRDLRFGAAFGFVGQVQVFQRGFVVGGFDLRPEVV

SEQ ID NO: 9142 - protein, 9 aa, Neisseria gonorrhoeae
KLALLFNAF

SEQ ID NO: 9143 - protein, 74 aa, Neisseria gonorrhoeae
HNGLALFQLAQVLQPLGKLAQLRIVQPARGFFTVTRDKGDGRAVVQKLDSGIDLHGSGGEFLGEDSGDVHKLPP

SEQ ID NO: 9144 - protein, 50 aa, Neisseria gonorrhoeae
CRLNSRRRNVGNRLEKMKIILIYFARYNLKGMFVYDRPDYRRHRLYRFAH

SEQ ID NO: 9145 - protein, 118 aa, Neisseria gonorrhoeae
IELADGFQHGFFDFGGNGGRSDVRAVFKGGFDNVLQRHNVSLVRDISGRLPVLFRRHGGWNKRAIVPYKRPPVSRAAGLPDAGVSESGGRQAYVFFRARINTERRRYFYAAPPPFRRH

SEQ ID NO: 9146 - protein, 9 aa, Neisseria gonorrhoeae
FFQHQIDDD

SEQ ID NO: 9147 - protein, 115 aa, Neisseria gonorrhoeae
YRSNRDTGKDVRPFEVVGENARRNGRHQSRLKGCQSLRRIHAFARHCAGKAVGFVKQFQHGRNNQRTNDTADNQGDLLPPRRSFEQVAGFQVLQVVVGNRSHADYCRSAKKRQRQ

SEQ ID NO: 9148 - protein, 21 aa, Neisseria gonorrhoeae
EFAVGLIRQQTSGFAYQQQNQ

SEQ ID NO: 9149 - protein, 65 aa, Neisseria gonorrhoeae
NNDDGHDAHAGNRAGRRADQTCHITAGGGDQKADDGSQKRANRHQKPRHAARNVRIADKVVKRHA

SEQ ID NO: 9150 - protein, 85 aa, Neisseria gonorrhoeae
NKHHRQHPENHGFRRQILFGAFCSGRTAAKTLERHLHAFHHWLEQHQKRPNRRDTYGSRTDKTHFFLPQLHRKRRHFHIGRLRNV

SEQ ID NO: 9151 - protein, 34 aa, Neisseria gonorrhoeae
GEIRHGNTPSNRNAQQDGDAARQSDQITRAQQGQ

SEQ ID NO: 9152 - protein, 98 aa, Neisseria gonorrhoeae
KAYRQLENCRTAFKPITRAIGNHTQTSGAKAHQSRQRAAGRQLFDTAAALTVIPFFMTAHFQNFSSRHTFRIRQIAFHHHRVTQRNGENHPQNPAGNT

SEQ ID NO: 9153 - protein, 25 aa, Neisseria gonorrhoeae
KRRLPKRETAPVARHQQTGQDEDDG

SEQ ID NO: 9154 - protein, 24 aa, Neisseria gonorrhoeae
KRTRSRGLGLHHVVFQNIAAFEKF

SEQ ID NO: 9155 - protein, 39 aa, Neisseria gonorrhoeae
NRHRNHRRRNRRGKGQPDFQTEVNVRRSKNYSDQCAEYH

SEQ ID NO: 9156 - protein, 48 aa, Neisseria gonorrhoeae
KRFLARRLVFQARRNPLKFFQKLFLTVGQIDRRFDNNMAVQIAGRAAA

SEQ ID NO: 9157 - protein, 32 aa, Neisseria gonorrhoeae
RFDTLTFHAHPPAGLGFFGDGELDFAVQGRHF

SEQ ID NO: 9158 - protein, 285 aa, Neisseria gonorrhoeae
LPAQSSHGKTNRQFAMQIQTIALENLMRPNADGYIQVAGRRAVHTRPAFTAQTDTLPVIDTGGNIDFHRLDRLIPPHATAFDARFFNMFARTAAGRTSLLHTENRLLDVHRTRTFASRAGFRGCPRFRAAAVADITRFISRNIDAFLHTFCGFFKRDFDTDLHVLTLIIRLGAPRTTSKHLAENIPKVKTLRTAKSAKPSEAPLSAAFKRRMTILVVHGTLFLVGQSFIRLLYFFKLLFRLFIVRIAVGMVFHRQFTVGFFNLIIGSCSCHTQRRIKILITHFFI

SEQ ID NO: 9159 - protein, 22 aa, Neisseria gonorrhoeae
QKPVRRCPAPAQRERFPKVMKH

SEQ ID NO: 9160 - protein, 73 aa, Neisseria gonorrhoeae
GFTLHQGFRLGKGVGNGKTAASVLRALRRHRDDKVAGNQARALVEQLEIGVLAVDPFTAEHDAARFARGGTAV

SEQ ID NO: 9161 - protein, 68 aa, Neisseria gonorrhoeae
SAAFAQTLHIELVQPRRQQAQVVAVRNGGLPVRVLEIVIPHGNQCHQNGNVATRGRVEKMAVHRVRPR

SEQ ID NO: 9162 - protein, 100 aa, Neisseria gonorrhoeae
QFAETRPANRNHHGQTDGRPDGIASAHPVVHRKHAFRRNAETLRRFRIGRHRAKMVRRFGFREPRTAIPRLDRLCIEQGFRCFKGLAGNAKHCCFGVQTA

SEQ ID NO: 9163 - protein, 54 aa, Neisseria gonorrhoeae
DLIQAGRVGIRNKMDGNLPSERLERLHAHCRPEVGSAYADVDKIRNPFSGYPLI

SEQ ID NO: 9164 - protein, 13 aa, Neisseria gonorrhoeae
TVVQTVCKLQRTI

SEQ ID NO: 9165 - protein, 131 aa, Neisseria gonorrhoeae
LAADFGQHVPAVRINGIRTVGQAQSRMQRGTPLAAVDFRTRPQSTHFPFQIRRLRKTAEQLQRIFAKTVFAVIEQHPVQTLMHTLKTVGFGSKAVAQKDVARILIMAFERIPCTGKSIHLFSLIFQNRIKI

SEQ ID NO: 9166 - protein, 4 aa, Neisseria gonorrhoeae
QNVV

SEQ ID NO: 9167 - protein, 13 aa, Neisseria gonorrhoeae
NPYFDKAYCFVVS

SEQ ID NO: 9168 - protein, 12 aa, Neisseria gonorrhoeae
SCLLCFRIKSIQ

SEQ ID NO: 9169 - protein, 15 aa, Neisseria gonorrhoeae
RSMRRYSTSQIKISC

SEQ ID NO: 9170 - protein, 8 aa, Neisseria gonorrhoeae
KQQTCFHL

SEQ ID NO: 9171 - protein, 22 aa, Neisseria gonorrhoeae
SFGGGKRDRTDDPLLAKQVLYQ

SEQ ID NO: 9172 - protein, 65 aa, Neisseria gonorrhoeae
SGCRACQQPLQADRFSRIGTESIVPFINIADGRLYFTEKFSFPIPGTEFQCVLFFLCGTVGRIGG

SEQ ID NO: 9173 - protein, 54 aa, Neisseria gonorrhoeae
FVFLEMPCCNGGVFDEFVLHFYQQFAEKSQMVVIHIIVFRPNPIQNILFCQLYH

SEQ ID NO: 9174 - protein, 11 aa, Neisseria gonorrhoeae
AGAGQRRTGFC

SEQ ID NO: 9175 - protein, 16 aa, Neisseria gonorrhoeae
FTIPSGRHLTRNNILQ

SEQ ID NO: 9176 - protein, 78 aa, Neisseria gonorrhoeae
RYIFLKLLEIFTRLLGKGNRSFKRCQTERACFCHIKPLSDGGILQCVQQIKHISRPAAADAGNAVHLRFIFQPNGQTD

SEQ ID NO: 9177 - protein, 82 aa, Neisseria gonorrhoeae
FHDSIGNPAVCFRYFRFGIHTGYAQPDFSGCIRHNPDNAAASPEVTAERTDRQSGCDRKHQCAVGADIFARGFHILRFDGKD

SEQ ID NO: 9178 - protein, 66 aa, Neisseria gonorrhoeae
NIVGMKLRQGCRSFDPQLFSQTFALFRTTVGYMDAVSPLFDQSARNGSRHISAAEKINIHYFYPIQ

SEQ ID NO: 9179 - protein, 7 aa, Neisseria gonorrhoeae
KRYLVVL

SEQ ID NO: 9180 - protein, 57 aa, Neisseria gonorrhoeae
RQRTLAANIPKIDGGRFSRLTPAGQGRTLIPPRQPAACNRKCKQRSRCRIFYYPNFH

SEQ ID NO: 9181 - protein, 76 aa, Neisseria gonorrhoeae
GATLPAQPDGGLQTAYGMHPMRAFGDKFGFVGLHIADDVPHDVGQIRQFLRFAVPLLNIVLAEITLSGSVNFADAV

SEQ ID NO: 9182 - protein, 39 aa, Neisseria gonorrhoeae
REGLADGNQADGMRLPARLQNQFSDTVGHLTITFLQHRH

SEQ ID NO: 9183 - protein, 20 aa, Neisseria gonorrhoeae
PATISCKIYCVRINAGQPPK

SEQ ID NO: 9184 - protein, 21 aa, Neisseria gonorrhoeae
GIIASDSVPFAARRRDVGGFH

SEQ ID NO: 9185 - protein, 12 aa, Neisseria gonorrhoeae
NHENPTPQASAH

SEQ ID NO: 9186 - protein, 47 aa, Neisseria gonorrhoeae
IPPRNIIFFNQLQFPSPVPFLQLFFPSNCALHRRMQFIPNRHSNVVP

SEQ ID NO: 9187 - protein, 24 aa, Neisseria gonorrhoeae
CKSFNQMLPMLVNTLHQIRCNANV

SEQ ID NO: 9188 - protein, 7 aa, Neisseria gonorrhoeae
RAITLAC

SEQ ID NO: 9189 - protein, 7 aa, Neisseria gonorrhoeae
NINRRLH

SEQ ID NO: 9190 - protein, 9 aa, Neisseria gonorrhoeae
RRSGFCFFR

SEQ ID NO: 9191 - protein, 16 aa, Neisseria gonorrhoeae
IPKTQNFIIPTKTENQ

SEQ ID NO: 9192 - protein, 183 aa, Neisseria gonorrhoeae
AFDTAHRAGNIQAVQIVHQQGAHTFSGEAPVIAGGFFTLFECSAAACITVCRDGEIVCFLFVQVTHINRFVVNISVRADGFAVFPHAAYGDGLAVHFLMAGILRNLVIRHNRARASRSQCAAVGGIDAQNGGLCAAFVITRIAADGDKGGTQYHGRFDGNALSFLQLHYPPLTARSVGSLVQE

SEQ ID NO: 9193 - protein, 185 aa, Neisseria gonorrhoeae
CFIFLFKHLLEQPASRAVLYRYLNRPLIVVKDTVNILFARIQYIIFGQIAARTEDDDAFVCQSGNGGRGSNRLVAFENSPYRPFIRIGIAQIKAVHIAAPVAGIGDIDRAVQIFIHQRGGRKPALAALHFDFFNQTTTAVFQIIYIQRGFIIAAANIFSRITGSEEGGVFAVLGFADLRRADGVA

SEQ ID NO: 9194 - protein, 30 aa, Neisseria gonorrhoeae
FHFHAIFAVIIAIFDIKQGSGGWIISVDFA

SEQ ID NO: 9195 - protein, 133 aa, Neisseria gonorrhoeae
IQGIRASAAKTHRTKHKEMFLLVLVICNAAQDKAAVHAVAVAHIAFFGKGAQLFGECRIVAFNILARHRAGDVAELQIVAAFITAAVFFEDMHHPVVRGGCQIPADRDNRAVDDVAQIAIAVFADAVSLAVFV

SEQ ID NO: 9196 - protein, 4 aa, Neisseria gonorrhoeae
FSVN

SEQ ID NO: 9197 - protein, 165 aa, Neisseria gonorrhoeae
FKSTVIGSSTNRPRQQHFFPLVGFKIDVRFLNNAESAVVAGVSKSDDLILVSIQFDQLYAAIQSDDCFPPHETRLFTFNIILIQGYEGIAAGFAGFSFSFQILKVDAAARTVGVGRNRSGIHLHLAILHRAEPQRGGGQCRRRGFGIIIGVRFVDAAACFDLRQA

SEQ ID NO: 9198 - protein, 14 aa, Neisseria gonorrhoeae
IDADFSFIFKRPIT

SEQ ID NO: 9199 - protein, 103 aa, Neisseria gonorrhoeae
KKSIQPVFPSFRQFDARFQGTQINCFALRDIFDLGFIQQVQFGVQIKGDGGVFVLPDITGRIFITVACRINEVLVFVLGVPTILLRHILVKIKYLFIVSFFFD

SEQ ID NO: 9200 - protein, 41 aa, Neisseria gonorrhoeae
ALAAQIERHAQPRIIRQFINGRIVAAFVFVYIQLVACLSLQ

SEQ ID NO: 9201 - protein, 51 aa, Neisseria gonorrhoeae
FRCRNAVRTVRTAFVLQEIERCSNGFMMYCGCLRRYGYGVIWTNAPEVPRH

SEQ ID NO: 9202 - protein, 18 aa, Neisseria gonorrhoeae
SVGRAFESLTTHQIKQKS

SEQ ID NO: 9203 - protein, 22 aa, Neisseria gonorrhoeae
VFKTRLFLSSDNPCSESAAFRQ

SEQ ID NO: 9204 - protein, 8 aa, Neisseria gonorrhoeae
CFMRCPEY

SEQ ID NO: 9205 - protein, 5 aa, Neisseria gonorrhoeae
NIIVD

SEQ ID NO: 9206 - protein, 397 aa, Neisseria gonorrhoeae
ERTNVDKLKISANGPLNGEITVSGAKNAALPLMCAGLLTSGTLRLKNVPMLADVKTTQKLLQGMGARVLTDNISEFEINGGTVNNTCAPYELVRTMRASILVLGPTLARFGEAQVSLPGGCAIGSRPVDQHLKGLEAMGAEIVIEHGYVKAKGKLKGTRVAMDVVTVGGTENLLMAATLAEGTTVLENCAIEPEVVDLAECLVKMGAKISGIGTSTMIVEGVDELHGCEHSVVPDRIEAGTFLCAVAITGGRVVLRNAAPKTMEVVLDKLVEAGAVIEAGDDWIAIDMRQRPKAVDIRTVVHPGFPTDMQAQFMALNAVAEGSCRVVETIFENRFMHVPELNRMGANITTEGNTAFVQGVERLSGAVVKATDLRASASLVIAGLAARGETVVEQIYH

SEQ ID NO: 9207 - protein, 34 aa, Neisseria gonorrhoeae
NDDGEKMVSVAFYFDVFAFCHASNQGLDLFGCQH

SEQ ID NO: 9208 - protein, 70 aa, Neisseria gonorrhoeae
DFTDEFVDLVQCLYPFRIHVGGFDHRQFGNVPVDCLHLGGRGCRVGGNDKDIRQGVTVKHGNQILVEIGL

SEQ ID NO: 9209 - protein, 105 aa, Neisseria gonorrhoeae
FFQTVFFADKADVVEPFVAHQQAADGIAVALCGGGFHIDGDLRRLIEFAQHALPALDAQVHKQRQGHGDGEHYEGKQCAERLAQKLFERGARGFDVQREVVDDAH

SEQ ID NO: 9210 - protein, 103 aa, Neisseria gonorrhoeae
SNALHNFQNTGPAQIHHTLLIGNVQNTHFRTVVHNHTLHFFADGHNLIHARTPLITLPPATVATDGAVKFPIFCKILIGETDFLQSRGRRAFHFLFAARTQPA

SEQ ID NO: 9211 - protein, 404 aa, Neisseria gonorrhoeae
KTLRHNQADRTGNIKRRDTHIQHTRQRRRRIIRVQCGKHHMPCLCRLNRNIGSFQITNLTDHNDVRVLTQERLQSSGKSQTLLIIDVNLIDARQVNLGRVFRRCNIYRLRIQNIQTGIERHRLTRTRRTGYQHHPVRTVNRFQQQFFLERLKTELVDVQRRGIGIQNPHHDLFAKQRRQCADTEIDRLAALLKGQLHPTVLRYPFFGNVQTRHYLNPGSKLPPYRNGRLNHLAELPVHTETDTRIVFVKLEMDVGCPATQGIRQSFMDKPRNRAVFCLLVVDIQGVAFLFLLPLPKLLKQRCRTRTHPIEQTRQLVILDNDQLNRNPCGRNGFLNLRHLGRIGNRKKYFVAPTENRHTVELHHLLLRQHPHQHPVARIMTQIKNRITEHPRNQCRKRLGRNDTV

SEQ ID NO: 9212 - protein, 38 aa, Neisseria gonorrhoeae
KQHRQHFLTRLRLIVVMLGPLNSNHLVLNQNPQQTYAH

SEQ ID NO: 9213 - protein, 68 aa, Neisseria gonorrhoeae
NQRTQNPYGQKNDTEVQPVLLDQRDKLYQCRLLHQQQYGCRDGNRIVVADHPQQNQRNQKQGNKTEIH

SEQ ID NO: 9214 - protein, 116 aa, Neisseria gonorrhoeae
KVANQHCRRIAEQIVCRCPPTAQIAFIDDIVVQECGSVDKLDHRCQRIQFLVIITDRLTRQNRHNRTQAFAARADDICTDLRNQCDIGLHRTVDDFIDFGKVFRQMSLEIGQILEH

SEQ ID NO: 9215 - protein, 52 aa, Neisseria gonorrhoeae
KLIQIAGNYISKAIRVHLFRRHMIARTAQTLTKQANNNTMPNFAQWCADINH

SEQ ID NO: 9216 - protein, 24 aa, Neisseria gonorrhoeae
FNRYLKPHLFTMRLFTYPIPDLIH

SEQ ID NO: 9217 - protein, 40 aa, Neisseria gonorrhoeae
LQVGQKTAFGFVVGVRYVVAGHRAFTGHFANSCHNQSPNF

SEQ ID NO: 9218 - protein, 15 aa, Neisseria gonorrhoeae
NSKTRFIPRKTMPFQ
